(12) United States Patent
Twine et al.

(10) Patent No.: US 7,611,839 B2
(45) Date of Patent: Nov. 3, 2009

(54) METHODS FOR DIAGNOSING RCC AND OTHER SOLID TUMORS

(75) Inventors: Natalie C. Twine, Goffstown, NH (US); Michael E. Burczynski, Swampscott, MA (US); William L. Trepicchio, Andover, MA (US); Andrew J. Dorner, Lexington, MA (US); Jennifer A. Stover, Topsfield, MA (US); Donna K. Slonim, North Andover, MA (US)

(73) Assignee: Wyeth, Madison, NJ (US)

( * ) Notice: Subject to any disclaimer, the term of this patent is extended or adjusted under 35 U.S.C. 154(b) by 56 days.

(21) Appl. No.: 10/717,597

(22) Filed: Nov. 21, 2003

(65) Prior Publication Data

US 2004/0110221 A1 Jun. 10, 2004

Related U.S. Application Data

(60) Provisional application No. 60/427,982, filed on Nov. 21, 2002, provisional application No. 60/459,782, filed on Apr. 3, 2003.

(51) Int. Cl.
*C12Q 1/68* (2006.01)
*C07H 21/02* (2006.01)

(52) U.S. Cl. .......................................... 435/6; 536/23.1
(58) Field of Classification Search ..................... 435/4, 435/6; 536/23.1
See application file for complete search history.

(56) References Cited

U.S. PATENT DOCUMENTS

| | | | |
|---|---|---|---|
| 4,489,710 A | 12/1984 | Spitler | |
| 4,522,811 A | 6/1985 | Eppstein et al. | |
| 4,569,789 A | 2/1986 | Blattler et al. | |
| 4,625,014 A | 11/1986 | Senter et al. | |
| 4,638,045 A | 1/1987 | Kohn et al. | |
| 4,671,958 A | 6/1987 | Rodwell et al. | |
| 4,751,180 A | 6/1988 | Cousens et al. | |
| 4,935,233 A | 6/1990 | Bell et al. | |
| 5,459,039 A | 10/1995 | Modrich et al. | |
| 5,498,531 A | 3/1996 | Jarrell | |
| 5,840,506 A | 11/1998 | Giordano | |
| 5,919,619 A | 7/1999 | Tullis | |
| 6,087,098 A | 7/2000 | McKiernan et al. | |
| 6,110,675 A | 8/2000 | Cohen et al. | |
| 6,190,857 B1 * | 2/2001 | Ralph et al. ..................... | 435/4 |
| 6,288,220 B1 | 9/2001 | Kambara et al. | |
| 6,303,301 B1 | 10/2001 | Mack et al. | |
| 6,317,731 B1 | 11/2001 | Luciano | |
| 6,391,562 B2 | 5/2002 | Kambara et al. | |
| 6,506,559 B1 | 1/2003 | Fire et al. | |
| 6,647,341 B1 | 11/2003 | Golub et al. | |
| 2001/0053548 A1 | 12/2001 | Rybak et al. | |
| 2002/0042072 A1 | 4/2002 | Van Meel | |
| 2002/0132274 A1 | 9/2002 | Nevalainen et al. | |
| 2002/0164664 A1 | 11/2002 | Hlavaty et al. | |
| 2002/0168638 A1 | 11/2002 | Schlegel et al. | |
| 2002/0182614 A1 | 12/2002 | Gillis et al. | |
| 2004/0175743 A1 | 9/2004 | Burczynski et al. | |
| 2004/0235020 A1 | 11/2004 | Burczynski et al. | |

FOREIGN PATENT DOCUMENTS

| | | |
|---|---|---|
| WO | WO 89/10134 | 11/1989 |
| WO | WO 97/07668 | 3/1997 |
| WO | WO 97/07669 | 3/1997 |
| WO | WO 99/14346 | 3/1999 |
| WO | WO 99/27132 | 6/1999 |
| WO | WO00/40749 | 7/2000 |
| WO | WO 00/44895 | 8/2000 |
| WO | WO 00/63364 | 10/2000 |
| WO | WO 01/29058 | 4/2001 |
| WO | WO 01/36646 | 5/2001 |
| WO | WO 01/68836 | 9/2001 |
| WO | WO 01/70949 | 9/2001 |
| WO | WO 01/75164 | 10/2001 |
| WO | WO01/81916 | 11/2001 |
| WO | WO 01/92513 | 12/2001 |
| WO | WO 02/08399 | 1/2002 |
| WO | WO 02/24924 | 3/2002 |
| WO | WO02/40000 | 5/2002 |
| WO | WO 02/40717 A2 | 5/2002 |
| WO | WO03/032813 | 4/2003 |
| WO | WO2004/048933 | 6/2004 |
| WO | WO2004/072265 | 8/2004 |

(Continued)

OTHER PUBLICATIONS

Olive et al. Expression of cytokine mRNA transcripts in renal cell carcinoma. Immunology and Cell Biology. vol. 76: 357-362. 1998.*

(Continued)

*Primary Examiner*—Sue Liu
(74) *Attorney, Agent, or Firm*—Joseph E. Zahner

(57) ABSTRACT

Methods, systems and equipment for diagnosing renal cell carcinoma (RCC) and other solid tumors. This invention identifies numerous disease genes that are differentially expressed in the peripheral blood of patients having RCC or other solid tumors relative to disease-free humans. These disease genes can be used as surrogate markers for detecting the presence or absence of RCC or other solid tumors.

7 Claims, 5 Drawing Sheets
(1 of 5 Drawing Sheet(s) Filed in Color)

FOREIGN PATENT DOCUMENTS

| WO | WO 2004/072265 A2 | 8/2004 |
|---|---|---|
| WO | WO 2004/094673 A2 | 11/2004 |
| WO | WO 2004/097052 A2 | 11/2004 |

OTHER PUBLICATIONS

Golub et al. Molecular classfication of cancer: class discovery and class prediction by gene expression monitoring. Science. vol. 286: 531-537. 1999.*
Liu et al. Upregulation of Toll-like receptor 2 gene expression in macrophage response to peptidoglycan and high concentration of lipopolysaccharide is involved in NG-kB Activation. Infection and Immunity. vol. 69: 2788-2796. 2001.*
Mayo et al., Biochimica et Biophysica Acta. vol. 1470: M55-M62; 2000.*
GenBank Printout, (http://www.ncbi.nih.gov/Genbank/index.html), "Updating or Revising a Sequence"; downloaded Feb. 21, 2007.*
UNIGENE Printout, "Hs.63668"; downloaded Feb. 21, 2007.*
Anand et al., Nature Genetics. Voll. 31: 301-305; 2002.*
Young et al., American Journal of Pathology. vol. 158(5): 1639-1651; May 2001.*
Palsson-McDermott et al., Ir J. Med. Sci. vol. 176: 253-260; 2007.*
El-Omar et al., Oncogene. vol. 27: 244-252; 2008.*
Thornton et al., J. Mol. Med. vol. 81: 536-548; 2003.*
U.S. Appl. No. 60/427,982, Burczynski. M. et al.
U.S. Appl. No. 60/459,782, Twine, N. C. et al.
U.S. Appl. No. 60/446,133, Burczynski. M. et al.
U.S. Appl. No. 60/538,246, Burczynski. M. et al.
U.S. Appl. No. 60/466,067, Dorner, A. et al.
Burczynski et al., "Pharmacogenomic expression profiling of renal cell carcinoma in a phase II trial of CCI-779: identification of surrogate markers of disease and predictors of outcome in the compartment of peripheral blood", *European Journal of Cancer, Pergamon Press*, Oxford, GB, vol. 38, Nov. 11, 2002, p. S51.
Schulze-Koops, H. et al., "Persistent reduction in IL-6 mRNA in peripheral blood mononuclear cells of patients with rheumatoid arthritis after treatment with a monoclonal antibody to CD54 (ICAM-1)", *Clinical and Experimental Immunology*, vol. 106, No. 2, Nov. 1996, pp. 190-196.
Dipaola, R.S., et al., "Phase I clinical and pharmacologic study of 13-cis-retinoic acid, interferon alfa, and paclitaxel in patients with prostate cancer and other advanced malignancies," *Journal of Clinical Oncology: Official Journal of the American Society of Clinical Oncology*, vol. 17, No. 7, Jul. 1999, pp. 2213-2218.
"Product Catalogue", Jan. 2001, *Affymetrix*, p. 1.
Lichtenfels, R. et al., "Identification of metabolic enzymes in renal cell carcinoma utilizing PROTEOMEX analyses", *Biochimica et Biophysica Acta*, vol. 1646, No. 1-2, Mar. 21, 2003, pp. 21-31.
Su, Andrew I., et al., "Large-scale analysis of the human and mouse transcriptomes," *Proceedings of the National Academy of Sciences of the United States of America*, vol. 99, No. 7, Apr. 2, 2002, pp. 4465-4470.
Database Source Online!, http://genome-www5.stanford.edu/cgi-bin/source/expressionSearch?option=cluster&criteria=Hs. 171501 &organism=Hs abstract.
Elit, Laurie, "CCI-779 Wyeth," *Current Opinion in Investigational Drugs* (London, England: 2000), vol. 3, No. 8, Aug. 2002, pp. 1249-1253.
Peralba, Josep Maria, et al., "Pharmacodynamic Evaluation of CCI-779, an Inhibitor of mTOR, in Cancer Patients," *Clinical Cancer Research: An Official Journal of the American Association for Cancer Research*, vol. 9, No. 8, Aug. 1, 2003, pp. 2887-2892.
Rininger, J., et al., "Differential gene expression technologies for identifying surrogate markers of drug efficacy and toxicity", *Drug Discovery Today United Kingdom*, vol. 5, No. 12, Dec. 1, 2000, pp. 560-568.
PCT International Search Report; PCT/US2004/006601; Nov. 19, 2004; 4 pages.

Deprimo et al., "Expression Profiling of Blood Samples from an SU5416 Phase III Metastatic Colorectal Cancer Clinical Trial: a Novel Strategy for Biomarker Identification", Biomed Central, pp. 1471-2407.
Altschul et al.; "*Gapped Blast and PSI-Blast: a New Generation of Protein Database Search Programs*", Nucleic Acids Research, 1997, pp. 3389-3402, vol. 25, No. 17, Oxford University Press.
Berger P. et al.; "*Loss of Phosphatase Activity in Myotubularin-Related Protein 2 is Associated With Charcot-Marie Tooth Disease Type 4BI*", Human Molecular Genetics, 2002, pp. 1569-1579, vol. 11, No. 13, Oxford University Press.
Boe R. et al.; "*The Protein Phosphatase Inhibitor Okadaic Acid Induces Morphological Changes Typical of Apoptosis in Mammalian Cells*", Experimental Cell Research 195, 1991, pp. 237-246, Academic Press, Inc.
Bottini N. et al.; "*Low-Molecular-Weight Protein Tyrosine Phosphatase and Human Disease: in Search of Biochemical Mechanisms*", Archivum Immunologiae Et Therapiae Experimentalis, 2002 pp. 95-104, vol. 50.
Brown-Shimer, et al.; "*Effect of Protein Tyrosine Phosphatase 1b Expression on Transformation by the Human neu Oncogene*", Cancer Research, 52, 1992, pp. 478-548.
Chen et al.; "*The Myotonic Dystrophy Kinase-Related Cdc42-Binding Kinase is Involved in the Regulation of Neurite Outgrowth in PC12 Cells*", The Journal of Biological Chemistry 1999, pp. 19901-19905, vol. 274, No. 28, The American Society for Biochemistry and Molecular Biology, Inc.
Delagrave et al.; "*Recursive Ensemble Mutagenesis*", Protein Engineering, 1993, pp. 327-331, vol. 6 No. 3, Oxford University Press.
Dong et al.; "*Cdc42 Antagonizes Inductive Action of cAMP on Cell Shape, Via Effects of the Myotonic Dystropht Kinase-Related Cdc42-Binding Kinase (MRCK) on Myosin Light Chain Phosphorylation*", European Journal of Cell Biology Apr. 2002, pp. 231-242, vol. 81.
Engelman et al.; "*Identifying Nonpolar Transbilayer Helices in Amino Acid Sequences of Membrane Proteins*", Ann. Rev. Biophys. Chem. 1986, pp. 321-353, vol. 15, Annual Reviews Inc.
Florea et al.; "*A Computer Program for Aligning A cDNA Sequence with a Genomic DNA Sequence*", Genome Research 1998, pp. 967-974, vol. 8, Cold Spring Harbor Laboratory Press.
Gossen et al.; "*Transcriptional Activation by Tetracyclines in Mammalian Cells*", Science Jun. 23, 1995, pp. 1766-1769, vol. 268.
Guatelli et al.; "*Isothermal, in Vitro Amplification of Nucleic Acids by a Multienzyme Reaction Modeled After Retroviral Replication*", Proc. Natl. Acad. Sci. USA, Mar. 1990, pp. 1874-1878, vol. 87.
Haseloff et al.; "*Simple RNA Enzymes with New and Highly Specific Endoribonuclease Activities*", Nature, Aug. 18, 1988, pp. 585-591, vol. 334.
Hyrup et al.; "*Peptide Nucleic Acids (PNA): Synthesis, Properties and Potential Applications*", Bioorganic & Medicinal Chemistry, 1996, pp. 5-23, vol. 4, No. 1, Elsevier Science Ltd., Great Britain.
Ishida et al.; "*Treatment of Myeloid Leukemic Cells With the Phosphatase Inhibitor Okadaic Acid Induces Cell Cycle Arrest at Either G1/S or G2/M Depending on Dose*", Journal of Cellular Physiology, 1992, pp. 484-492.
Janssens et al.; "*Protein Phosphatase 2A: a Highly Regulated Family of Serine/Threronine Phosphatases Implicated in Cell Growth and Signaliing*," Biochem. J., 353, 2001, pp. 417-443.
Kedra et al.; "*The Germinal Center Kinase Gene and a Novel CDC25-Like Gene are Located in the Vicinity of the PYGM Gene on 11q13*", Hum. Genet., 1997, pp. 611-619, vol. 100.
Keen et al.; *Rapid Detection of Single Base Mismatches as Heteroduplexes on Hydrolink Gels*, Trends in Genetics, 1997, p. 5, vol. 7.
Kwoh et al.; "*Transcription-Based Amplification System and Detection of Amplified Human Immunodeficiency Virus Type 1 With a Bead-Based Sandwich Hybridization Format*", Proc. Natl. Acad. Sci. USA, Feb. 1989, pp. 1173-1177, vol. 86.
Lam et al.; "*Characterization of a Monoclonal Antibody Panel Shows That the Myotonic Dystrophy Protein Kinase, DMPK, is Expressed Almost Exclusively in Muscle and Heart*", Human Molecular Genetics, 2000, pp. 2167-2173, vol. 9, No. 4, Oxford University Press.

Lee et al.; "*Expression of Small Interfering RNAs Targeted Against HIV-1 rev Transcripts in Human Cells*", Nature Biotechnology, May 2002, pp. 500505, vol. 19.

Leung et al.; "*Myotonic Dystrophy Kinase-Related Cdc42-Binding Kinase Acts as a Cdc42 Effector in Promoting Cytoskeletal Reorganization*", Molecular and Cellular Biology, Jan. 1998, pp. 130-140, vol. 18, No. 1, American Society for Microbiology.

Lizardi et al.; "*Exponential Amplification of Recombinant-RNA Hybridization Probes*", Biotechnology, Oct. 1988, pp. 1197-1202, vol. 6.

Maratea et al.; "*Deletion and Fusion Analysis of the Phage 0x174 Lysis Gene E*", Gene, 1985, pp. 39-46, vol. 40, Elsevier Science Publishers.

Meyers et al.; "*Optimal Alignments in Linear Space*", CABIOS, 1988, pp. 11-17, vol. 4, No. 1, Press Limited, Oxford England.

Murphy et al.; "*Genetic Construction, Expression, and Melanoma-Selective Cytotoxicity of a Diphtheria Toxin-Related α-Melanoma-Stimulating Hormone Fusion Protein*", Proc. Natl. Aca. Sci. USA, Nov. 1986, pp. 8258-8262, VO. 83.

Needleman et al.; "*A General Method Applicable to the Search for Similarities in the Amino Acid Sequence of Tow Proteins*", J. Mol. Bio., 1970, pp. 443-453, vol. 48.

No et al.; "*Ecdysone-Inducible Gene Expression in Mammalian Cells and Transgenic Mice*", Proc. Natl. Acad. Sci. USA, Apr. 1996, pp. 3346-3351, vol. 93.

Nomura et al.; "*Enhancement by Cyclosporin A of Taxol-Induced Apoptosis of Human Urinary Bladder Cancer Cells*", Urol Res, 2002, pp. 102-111, vol. 30.

O'Gorman et al.; "*Recombinase-Mediated Gene Activation and Site-Specific Integration in Mammalian Cells*", Science, Mar. 1991, pp. 1351-1355.

Rosenbaum et al.; "*Temperature-Gradient Gel Electrophoresis*", Biophysical Chemistry, 1987, pp. 235-246, vol. 26.

Saiki et al.; "*Genetic Analysis of Amplified DNA With Immobilized Sequence-Specific Oligonucleotide Probes*", Proc. Natl. Acad. Sci. USA, Aug. 1989, pp. 6230-6234, vol. 86.

Straub et al.; "*Genome-Wide Scans of Three Independent Sets of 90 Irish Multiplex Schizophrenia Families and Follow-Up of Selected Regions in All Families Provides Evidence for Multiple Susceptibility Genes*", Mol. Psychiatry, 2002, pp. 542-559, vol. 7, No. 6.

Sui et al.; "*A DNA Vector-Based RNAi Technology to Suppress Gene Expression in Mammalian Cells*", Proc. Natl. Acad. Sci., Apr. 16, 2002, pp. 5515-5520, vol. 99, No. 8.

Tan et al.; "*Phosphorylation of a Novel Myosin Binding Subunit of Protein Phosphatase I Reveals a Conserved Mechanism in the Regulation of Actin Cytoskeleton*", The Journal of Biological Chemistry, 2001, pp. 21209-21216, vol. 276, No. 24.

Tan et al.; "*Intermolecular and Intramolecular Interactions Regulate Catalytic Activity of Myotonic Dystrophy Kinase-Related Cdc42-Binding Kinase α*", Molecular and Cellular Biology, Apr. 2001, pp. 2767-2778, vol. 21, No. 8.

Wang et al.; "*Ligand-Inducible and Liver-Specific Target Gene Expression in Transgenic Mice*", Nature Biotechnology, Mar. 1997, pp. 239-243, vol. 15.

Wary et al.; "*A Homozygous Deletion Within the Carbonic Anhydrase-Like Domain of the Ptprg Gene in Murine L-Cells*", Cancer Research, Apr. 1, 1993, pp. 478-482, vol. 53.

Wilmut et al.; "*Viable Offspring Derived from Fetal and Adult Mammalian Cells*", Letters to Nature, Feb. 1997, pp. 810-813, vol. 385.

Ye et al.; "*Regulated Delivery of Therapeutic Proteins After in Vivo Somatic Cell Gene Transfer*," Science, Jan. 1999, pp. 88-91, vol. 283.

Zhao et al.; "*Reversible Modification of Tissue-Type Plasminogen Activator by Methyphosphonate Esters*." Bioorganic & Medicinal Chemistry, 1996, pp. 523-529, vol. 4.

Zy; "*Protein Tyrosine Phosphatases: Structure and Function, Substrate Specificity, and Inhibitor Development*," Annu Rev Pharmacol Toxicol, 2002, pp. 209-234, vol. 42.

International Search Report for PCT/US2004/004118, mailed Jan. 19, 2005, 9 sheets.

International Search Report for PCT/US2004/013587, mailed Jan. 25, 2005, 9 sheets.

International Search Report for PCT/US2003/037481, mailed Aug. 23, 2005, 3 sheets.

A. H. Kibbe, Handbook of Pharmaceutical Excipients, 3rd Edition, Pharmaceutical Press, London, U.K., 2000.

Affymetrix GeneChip® Expression Analysis, Data Analysis Fundamentals.

Affymetrix GeneChip® Expression Analysis Technical Manual.

Armstrong, S. A. et al., MLL translocations specify a distinct gene expression profile that distinguishes a unique leukemia, *Nat. Genet.*, 30(1):41-47, 2002.

Bosma, A. J. et al., Detection of circulating breast tumor cells by differential expression of marker genes, *Clin. Cancer Res.*, 8(6):1871-1877, 2002.

Cox, D. R., Regression models and life-tables, *Meeting of the Research Section of the Royal Statistical Society*, pp. 187-220, 1972.

Davis I. J. et al., Cloning of an *Alpha-TFEB* fusion in renal tumors harboring the t(6;11)(p21;q13) chromosome translocation, *Proc. Natl. Acad. Sci. USA*, 100(10):6051-6056, 2003.

Deprimo, S.E. et al., Expression profiling of blood samples from an SU5416 Phase III metastatic colorectal cancer clinical trial: a novel strategy for biomarker identification, *BMC Cancer*, 3(3):1-12, 2003.

Eisen, M. B. et al., Cluster analysis and display of genome-wide expression patterns, *Proc. Natl. Acad. Sci. USA*, 95:14863-14868, 1998.

Golub, T. R. et al., Molecular classification of cancer: class discovery and class prediction by gene expression monitoring, *Science*, 286(15):531-537, 1999.

Hill, A. A. et al., Genomic analysis of gene expression in *C. elegans*, *Science*, 290:809-812, 2000.

Hill, A. A. et al., Evaluation of normalization procedures for oligonucleotide array data based on spiked cRNA controls, *Genome Biology*, 2(12):1-13, 2001.

Kovacs, G. et al., The Heidelberg classification of renal cell tumours, *J. Pathol.*, 183(2):131-133, 1997.

Lockhart, D. J. et al., Expression monitoring by hybridization to high-density oligonucleotide arrays, *Nat. Biotechnol.*, 14(13):1675-1680, 1996.

Motzer, R. J. et al., Survival and prognostic stratification of 670 patients with advanced renal cell carcinoma, *J. Clin. Oncol.*, 17(8):2530-2540, 1999.

Pai S. M. et al., Population pharmacokinetic analysis of didanosine (2',3'-dideoxyino-sine) plasma concentrations obtained in phase I clinical trials in patients with AIDS or AIDS-related complex, *J. Clin. Pharmacol.*, 32(3):242-247, 1992.

Park, W.Y. et al., Identification of radiation-specific responses from gene expression profile, *Oncogene*, 21(55):8521-8528, 2002.

Peralba, J.-M. et al., Pharmacodynamic evaluation of the rapamycin ester CCI-779, *Proceedings of the American Association for Cancer Research Annual Meeting*, vol. 43, Mar. 2002 (2002-2003), pp. 1000-1001, Abstract No. 4961, and 93rd *Annual Meeting of the American Association for Cancer Research*, San Franscisco, CA, Apr. 6-10, 2002.

Pomeroy, S. L. et al., Supplemental Information for Nature's Paper: Prediction of central nervous system embryonal tumour outcome based on gene expression pp. 1-104, 2002.

Pomeroy, S. L. et al., Prediction of central nervous system embryonal tumour outcome based on gene expression, *Nature*, 415(6870):436-442, 2002.

Ramaswamy, S. et al., Multiclass cancer diagnosis using tumor gene expression signatures, *Proc. Natl. Acad. Sci. USA*, 98(26):15149-15154, 2001.

Slonim, D. K. et al., Class prediction and discovery using gene expression data, Proceedings of the Fourth Annual International Conference on "Computational Molecular Biology," Tokyo, Japan, pp. 263-272, 2000.

Snedecor, G. W. and Cochran, W. G., Correlation, In Statistical Methods, Eight Edition, Chapter 10, pp. 177-195, Iowa State University Press, Ames, Iowa, 1989.

Su, A. I. et al., Molecular classification of human carcinomas by use of gene expression signatures, *Cancer Res.*, 61:7388-7393, 2001.

Van De Vlijver, M. J. et al., A gene-expression signature as a predictor of survival in breast cancer, *N. Engl. J. Med.*, 347(25):1999-2009, 2002.

WHO Handbook for Reporting Results of Cancer Treatment, WHO Offset Publication No. 48, pp. 1-45, World Health Organization, Geneva, Switzerland, 1979.

Twine et al., "Disease-associated Expression Profiles in Peripheral Blood Mononuclear Cells from Patients with Advanced Renal Cell Carcinoma," *Cancer Research*, (63), pp. 6069-6075 (2003).

* cited by examiner

METHODS FOR DIAGNOSING RCC AND OTHER SOLID TUMORS

This application incorporates by reference the entire disclosure of U.S. Provisional Application Ser. No. 60/427,982, filed Nov. 21, 2002 and entitled "Methods for Diagnosing RCC and/or Solid Tumors." This application also incorporates by reference the entire disclosure of U.S. Provisional Application Ser. No. 60/459,782, filed Apr. 3, 2003 and entitled "Methods for Diagnosing RCC and/or Solid Tumors." In addition, this application incorporates by reference all materials recorded in compact discs "Copy 1" and "Copy 2." Each of the compact discs includes the sequence listing file entitled "AM101080L Sequence Listing.ST25.txt" (2,206 KB, created on Nov. 20, 2003).

TECHNICAL FIELD

This invention relates to methods, systems and equipment for diagnosing RCC and other solid tumors.

BACKGROUND

Renal cell carcinoma (RCC) comprises the majority of all cases of kidney cancer and is one of the most common cancers in industrialized countries. When detected early, radical nephrectomy can result in an excellent survival rate for RCC patients. However, the survival rate for patients with metastasized RCC tumors is reduced dramatically. Therefore, there is a need to provide methodologies, systems and equipment for the early diagnosis of RCC.

RCC patients frequently have non-specific symptoms or are completely asymptomatic. In fact, a significant percentage of renal lesions are incidentally detected by non-invasive imaging techniques. General screening methods for RCC are available, but these methods lack sufficient sensitivity and specificity for broad application. Recent U.S. Pat. No. 6,087,098 generally describes an RT-PCR based method for detecting the expression of the MN gene in peripheral blood samples. The MN protein is believed to be a marker of malignant renal cells. Therefore, detection of the MN gene expression in the peripheral blood suggests the presence of RCC.

The present invention represents a significant advance in the diagnosis of RCC and/or other solid tumors such as prostate cancer and head/neck cancer. The diagnostic test of the present invention relies on the detection of gene expression patterns in peripheral blood cells rather than in tumor cells themselves. As such, the present invention allows widespread screen for early stages of solid tumor progression.

SUMMARY OF THE INVENTION

The present invention identifies numerous disease genes that are differentially expressed in the peripheral blood of patients having RCC or other solid tumors as compared to disease-free humans. These disease genes can be used as surrogate markers for detecting the presence or absence of RCC or other solid tumors.

In accordance with one aspect of the present invention, a method is provided that is useful for diagnosis of RCC and other solid tumors. The method comprises the steps of providing at least one peripheral blood sample of a human, and comparing an expression profile of one or more genes in the at least one peripheral blood sample to at least one reference expression profile of the one or more genes. Each of the one or more genes is differentially expressed in PBMCs of patients having a solid tumor as compared to PBMCs of disease-free humans, provided that if the one or more genes consist of only one gene, the gene is not selected from the group consisting of IL1B, IL6, MMP-9 and FCGR3B, and further provided that if the one or more gene consist of two genes, the two genes are not IL1B and IL6.

The peripheral blood sample can be a whole blood sample or a sample comprising enriched peripheral blood mononuclear cells (PBMCs). Other peripheral blood samples can also be used. The solid tumor can be, for example, RCC, prostate cancer, or head/neck cancer. The human being investigated can have the solid tumor, or is free from the solid tumor or other diseases.

The reference expression profile(s) can include an expression profile of the one or more genes in peripheral blood samples of disease-free humans. The reference expression profile(s) can also include an expression profile of the one or more genes in peripheral blood samples of patients having the solid tumor. In addition, the reference expression profile(s) can further include an expression profile of the one or more genes in peripheral blood samples of patients having another solid tumor. The expression profile of the human being investigated can be compared to different reference expression profiles using a weighted voting algorithm.

The expression profile of the human being investigated and the reference expression profile(s) can be determined using quantitative RT-PCR, Northern Blot, in situ hybridization, Southern Blot, slot-blotting, nuclease protection assay, or nucleic acid arrays. The expression profiles can also be determined using immunoassays such as ELISA (enzyme-linked immunosorbent assay), RIA (radioimmunoassay), FACS (fluorescence-activated cell sorter), or Western Blot. In addition, methods based on 2-dimensional SDS-polyacrylamide gel electrophoresis can be used.

In a preferred embodiment, the one or more genes include at least 1, 2, 3, 4, 5, 6, 7, 8, 9, 10, 12, 14, 16, 18, 20, or more genes selected from Gene-Table-4. In another preferred embodiment, the one or more genes include at least 1, 2, 3, 4, 6, 8, 10, 12, 14, 16, 18, 20, or more genes selected from Table-6. In yet another preferred embodiment, the one or more genes include a classifier identifiable using a two-class or multi-class correlation metric algorithm.

In still another embodiment, the one or more genes include at least 1, 2, 3, 4, 5, 6, 7, 8, 9, 10, 12, 14, 16, 18, or 20 genes selected from the group consisting of: EEF1A2, TLR2, BRF2, LGALS3, SNRPG, DKFZP586E1621, NUMA1, SOD2, AKR1B1, DUSP6, SMARCE1, KIAA0669, MSF, IL1RN, PTMA, KIAA0410, PSMD3, T54, C1QBP, and OSR1.

In a further embodiment, the one or more genes include at least 1, 2, 3, 4, 5, 6, 7, 8, 9, 10, 12, 14, 16, 18, or 20 genes selected from the group consisting of: CD44, KIAA0410, MARCO, MAP3K8, NSP-CL, PIP5K1C, NRG1, RAB31, LGALS3, MEF2D, ITGA7, LHFPL2, ETS2, KHSRP, ENIGMA, UNK_AF038187, RAB13, TLR2, T54 and DUSP6.

In yet another embodiment, the one or more genes include at least 1, 2, 3, 4, 5, 6, 7, 8, 9, 10, 12, 14, 16, 18, or 20 genes selected from the group consisting of: CD44, CRADD, CCRL2, KIAA0837, KIAA0707, KIAA113, EREG, UNK_AL050119, PPARD, CTSL, ATP2B1, UNK_AF052115, MITF, STAT3, KIAA0410, TPD52L2, UNK_AI732885, MARCO, LOC64116, and PDNP2.

In still yet another embodiment, the one or more genes include at least 1, 2, 3, 4, 5, 6, 7, 8, 9, 10, 12, 14, 16, 18, 20, or more genes selected from the group consisting of: FABP5, SCYA20, ADM, COPEB, FCGR3B, UNK_M62896, FN1, HMOX1, ITGA7, DGCR5, CBP2, SLC1A4, MMP9, SLC16A3, LILRB3, FCGR1A, LHFPL2, PLEC1, S100A11, SPOP, CCR1, TLR2 and KIAA0750.

In another embodiment, the one or more genes include at least 1, 2, 3, 4, 5, 6, 7, 8, 9, 10, 12, 14, 16, 18, 20, or more genes selected from the group consisting of: ADM, COPEB, AQP9, PTGS2, STIP1, SOD2, PDXK, IL1RN, ANXA5, IFIT4, IL1B, GRO1, PLAUR, NP, MMP9, SLC16A3, LILRB3, FCGR1A, LHFPL2, PLEC1, S100A11, SPOP, CCR1, TLR2, KIAA0750, CDC34, POLR2J, ETS2, MAD, GPR3, PIP5K1C, PRF1, PSMA7, INPP4A, TCFL1, DGAT, S100P, DOC-1R, C8FW, PDI2, GEF-2, TNNT1, BSG, IL17R, HK3, RALBP1, RNASE2, TPM1, BLVRB, APS, PPARD, NFE2, IL1RAP, S100A12, CD9, ENIGMA, HAGH, NCF1, FLOT1, ITGA2B, KIAA0750, FKBP8, DUSP6 and CBFA2T3.

In yet another embodiment, the one or more genes include at least 1, 2, 3, 4, 5, 6, 7, 8, 9, 10, 12, 14, 16, 18, or more genes selected from the group consisting of: NUMA1, CXCR4, IL10RA, M9, FAU, BRF2, RPS6, EEF1A2, BAG5, AKR1B1, UNK_AL022721, C1QBP, DKZP586E0820, NONO, PSMD3, UNK_N74607, UNK_AI743507, MAP-KAPK5, and UNK_U79297.

In another preferred embodiment, the one or more genes include at least 1, 2, 3, 4, 5, 6, 7, 8, 9, 10, 12, 14, 16, 18, 20, or more genes, each of which has an RNA transcript capable of hybridizing under stringent conditions to a different respective classification probe sequence (CPS) selected from CPS-Table-2. In one specific example, if the one or more genes consist of only one gene, the RNA transcript(s) of the gene can not hybridize under stringent conditions to a CPS selected from the group consisting of CPSs 58, 211, 221 and 241. In another specific example, if the one or more genes consist of two genes, the RNA transcript(s) of the two genes can not hybridize under stringent conditions to CPSs 211 and 241.

In one embodiment, the one or more genes include at least 1, 2, 3, 4, 5, 6, 7, 8, 9, 10, 12, 14, 16, 18, or 20 genes, each of which has an RNA transcript capable of hybridizing under stringent conditions to a different respective CPS selected from the group consisting of: CPS 1, CPS 3, CPS 4, CPS 6, CPS 18, CPS 38, CPS 53, CPS 255, CPS 256, CPS 257, CPS 258, CPS 259, CPS 260, CPS 261, CPS 262, CPS 263, CPS 264, CPS 265, CPS 266, and CPS 267.

In another embodiment, the one or more genes include at least 1, 2, 3, 4, 5, 6, 7, 8, 9, 10, 12, 14, 16, 18, or 20 genes, each of which has an RNA transcript capable of hybridizing under stringent conditions to a different respective CPS selected from the group consisting of: CPSs 1, 3, 4, 5, 6, 7, 9, 10, 11, 16, 28, 31, 268, 264, 279, 280, 281, 282, 283 and 284.

In yet another embodiment, the one or more genes include at least 1, 2, 3, 4, 5, 6, 7, 8, 9, 10, 12, 14, 16, 18, or 20 genes, each of which has an RNA transcript capable of hybridizing under stringent conditions to a different respective CPS selected from the group consisting of: CPSs 17, 31, 37, 50, 59, 64, 69, 71, 264, 268, 269, 270, 271, 272, 273, 274, 275, 276, 277 and 278.

In still yet another embodiment, the one or more genes include at least 1, 2, 3, 4, 5, 6, 7, 8, 9, 10, 12, 14, 16, 18, 20, or more genes, each of which has an RNA transcript capable of hybridizing under stringent conditions to a different respective CPS selected from the group consisting of: CPSs 1, 2, 8, 16, 19, 26, 28, 57, 58, 61, 91, 92, 99, 138, 143, 148, 152, 191, 192, 207, 221, 229, 236 and 245.

In yet another embodiment, the one or more genes include at least 1, 2, 3, 4, 5, 6, 7, 8, 9, 10, 12, 14, 16, 18, 20, or more genes, each of which has an RNA transcript capable of hybridizing under stringent conditions to a different respective CPS selected from the group consisting of: CPSs 1, 4, 9, 10, 11, 12, 14, 17, 18, 19, 21, 25, 28, 34, 35, 40, 47, 52, 53, 58, 61, 62, 84, 87, 91, 92, 94, 99, 104, 105, 109, 111, 115, 125, 128, 130, 133, 135, 138, 143, 146, 147, 148, 151, 154, 157, 158, 165, 173, 174, 178, 191, 192, 194, 195, 201, 211, 220, 222, 227, 244, 247 and 250.

In one further embodiment, the one or more genes include at least 1, 2, 3, 4, 5, 6, 7, 8, 9, 10, 12, 14, 16, 18, or more genes, each of which has an RNA transcript capable of hybridizing under stringent conditions to a different respective CPS selected from the group consisting of: CPSs 107, 131, 255, 256, 258, 259, 265, 266, 285, 286, 287, 288, 289, 290, 291, 292, 293, 294, and 295.

In yet another preferred embodiment, the one or more genes include at least 1, 2, 3, 4, 5, 6, 7, 8, 9, 10, 12, 14, 16, 18, 20, or more genes, each of which has an RNA transcript capable of hybridizing under stringent or nucleic acid array hybridization conditions to a different respective qualifier selected from ATTACHMENT A. In one specific example, if the one or more genes consist of only one gene, the RNA transcript(s) of the gene can not hybridize under stringent or nucleic acid array hybridization conditions to a qualifier selected from the group consisting of 37148_at, 39402_at, 31859_at and 38299_at. In another specific example, if the one or more genes consist of two genes, the RNA transcript(s) of the two genes can not hybridize under stringent or nucleic acid array hybridization conditions to qualifiers 39402_at and 38299_at.

In accordance with another aspect of the present invention, a method is provided that is useful for diagnosing or confirming a non-blood disease. The non-blood disease can be a solid tumor such as RCC, prostate cancer, or head/neck cancer. The non-blood disease can also be a non-tumor disease, including diseases capable of causing renal failure. The method includes the steps of providing at least one peripheral blood sample of a human having the non-blood disease, and comparing an expression profile of one or more genes in the at least one peripheral blood sample to at least one reference expression profile of the one or more genes, where each of the one or more genes is differentially expressed in PBMCs of patients having the non-blood disease as compared to PBMCs of disease-free humans.

In one embodiment, the one or more genes comprise at least 1, 2, 3, 4, 5, 6, 7, 8, 9, 10, 12, 14, 16, 18, 20, or more genes selected from Gene-Table-4, and the peripheral blood sample is a whole blood sample or a sample comprising enriched PBMCs. In another embodiment, the reference expression profile(s) include an expression profile of the one or more genes in peripheral blood samples of humans who do not have the non-blood disease or are disease-free. In yet another embodiment, the average expression level of each of the one or more genes in PBMCs of patients having the non-blood disease is substantially higher or substantially lower than that in PBMCs of humans who do not have the non-blood disease or are disease-free.

In accordance with yet another aspect of the present invention, a method is provided that is useful for identifying a gene that is differentially expressed in peripheral blood samples of non-blood disease patients as compared to peripheral blood samples of reference humans. The method comprises the steps of providing an expression profile of one or more genes in peripheral blood samples of non-blood disease patients, providing a reference expression profile of the one or more genes in peripheral blood samples of reference humans, and comparing the expression profile to the reference expression profile to identify a gene that is differentially expressed in non-blood disease patients relative to reference humans. The expression profile and the reference expression profile can be determined, for example, by hybridizing cRNA or cDNA prepared from the peripheral blood samples to one or more nucleic acid arrays. The reference humans can be disease-free humans. The reference humans can also have the non-blood disease but at a different disease stage or with a different clinical response than the patients being investigated. In one embodiment, the non-blood disease is a solid tumor.

In accordance with still yet another aspect of the present invention, a kit is provided that is useful for diagnosis of RCC or other solid tumors. In one embodiment, the kit includes at least 1, 2, 3, 4, 5, 6, 7, 8, 9, 10, 15, 20, 25, 30, or more polynucleotides, each polynucleotide capable of hybridizing under stringent conditions to an RNA transcript, or the complement thereof, of a different respective gene which is differentially expressed in PBMCs of patients having a solid tumor as compared to PBMCs of disease-free humans. In another embodiment, the kit includes at least 1, 2, 3, 4, 5, 6, 7, 8, 9, 10, 15, 20, 25, 30, or more antibodies, each antibody capable of binding to a polypeptide encoded by a different respective gene which is differentially expressed in PBMCs of patients having a solid tumor relative to disease-free humans.

In accordance with a further aspect of the present invention, a system is provided that is useful for diagnosis of a non-blood disease. The non-blood disease can be a solid tumor, such as RCC, prostate cancer, or head/neck cancer. The system includes a memory which stores one or more reference expression profiles of at least one gene in peripheral blood samples of references humans. Each gene is differentially expressed in PBMCs of patients having the non-blood disease as compared to PBMCs of disease-free humans. The peripheral blood samples can be whole blood samples or samples comprising enriched PBMCs. The one or more reference expression profiles can include a peripheral blood expression profile of disease-free humans. The one or more reference expression profiles can also include a peripheral blood expression profile of patient having the non-blood disease. In addition, the one or more reference expression profiles can include a peripheral blood expression profile of patients having another non-blood disease. The system further includes a program capable of comparing an expression profile of interest to the one or more reference expression profiles, and a processor capable of executing the program. In one embodiment, the program employs a weighted voting algorithm.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The drawings are provided for illustration, not limitation.

DETAILED DESCRIPTION

I. Definition

Figure 1:
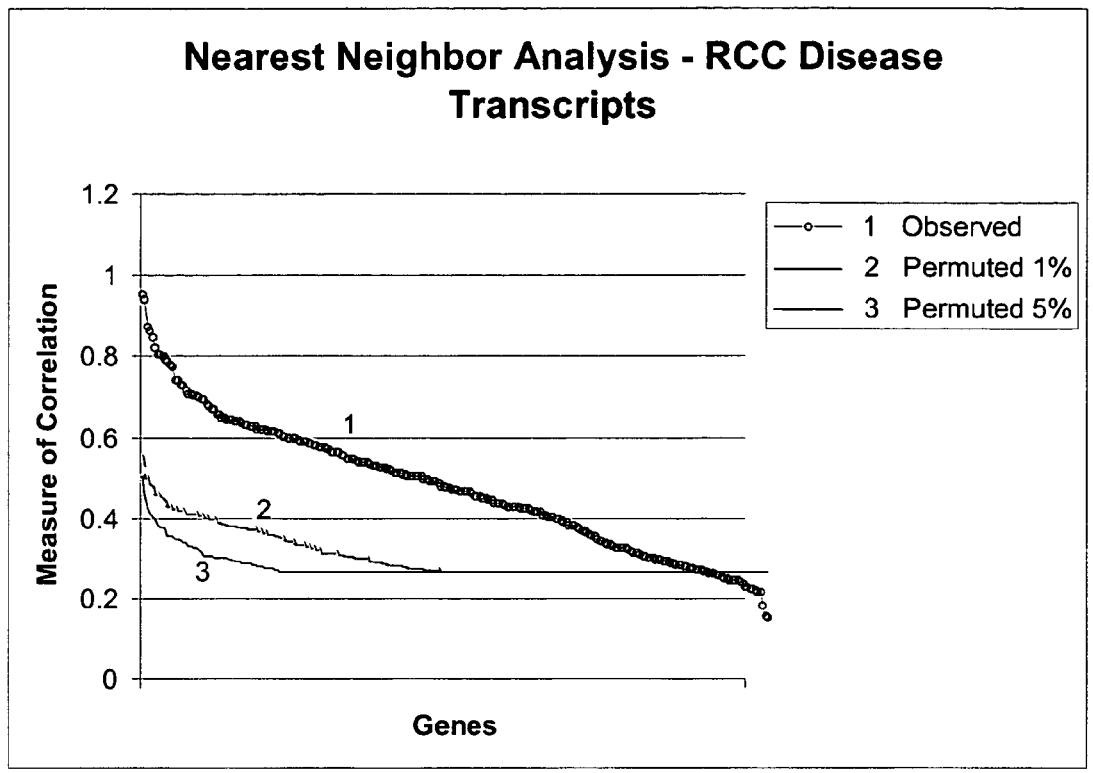
FIG. 1 depicts the statistical verification of the RCC disease genes identified in this invention.

As used herein, "CPS-Table-2" refers to the entire classification probe sequences (CPSs) listed in Table 2.

"Gene-Table-4" refers to all of the genes listed in Table 4.

A "gene" refers to a DNA sequence in the human genome, from which at least one RNA molecule can be transcribed. As used in the present invention, a gene can be a hypothetical or putative gene the expression of which is supported by EST or mRNA data.

A "disease-free human" refers to a human who does not have any detectable cancer or other diseases which require medical attention or treatment.

"Stringent conditions" are at least as stringent as, for example, conditions G-L shown in Table 1. "Highly stringent conditions" are at least as stringent as conditions A-F shown in Table 1. As used in Table 1, hybridization is carried out under the hybridization conditions (Hybridization Temperature and Buffer) for about four hours, followed by two 20-minute washes under the corresponding wash conditions (Wash Temp. and Buffer).

TABLE 1

Stringency Conditions

| Stringency Condition | Polynucleotide Hybrid | Hybrid Length (bp)[1] | Hybridization Temperature and Buffer[H] | Wash Temp. and Buffer[H] |
|---|---|---|---|---|
| A | DNA:DNA | >50 | 65° C.; 1xSSC -or- 42° C.; 1xSSC, 50% formamide | 65° C.; 0.3xSSC |
| B | DNA:DNA | <50 | $T_B^*$; 1xSSC | $T_B^*$; 1xSSC |
| C | DNA:RNA | >50 | 67° C.; 1xSSC -or- 45° C.; 1xSSC, 50% formamide | 67° C.; 0.3xSSC |
| D | DNA:RNA | <50 | $T_D^*$; 1xSSC | $T_D^*$; 1xSSC |
| E | RNA:RNA | >50 | 70° C.; 1xSSC -or- 50° C.; 1xSSC, 50% formamide | 70° C.; 0.3xSSC |
| F | RNA:RNA | <50 | $T_F^*$; 1xSSC | $T_F^*$; 1xSSC |
| G | DNA:DNA | >50 | 65° C.; 4xSSC -or- 42° C.; 4xSSC, 50% formamide | 65° C.; 1xSSC |
| H | DNA:DNA | <50 | $T_H^*$; 4xSSC | $T_H^*$; 4xSSC |

TABLE 1-continued

Stringency Conditions

| Stringency Condition | Polynucleotide Hybrid | Hybrid Length (bp)[1] | Hybridization Temperature and Buffer[H] | Wash Temp. and Buffer[H] |
|---|---|---|---|---|
| I | DNA:RNA | >50 | 67° C.; 4xSSC -or- 45° C.; 4xSSC, 50% formamide | 67° C.; 1xSSC |
| J | DNA:RNA | <50 | $T_J*$; 4xSSC | $T_J*$; 4xSSC |
| K | RNA:RNA | >50 | 70° C.; 4xSSC -or- 50° C.; 4xSSC, 50% formamide | 67° C.; 1xSSC |
| L | RNA:RNA | <50 | $T_L*$; 2xSSC | $T_L*$; 2xSSC |

[1]The hybrid length is that anticipated for the hybridized region(s) of the hybridizing polynucleotides. When hybridizing a polynucleotide to a target polynucleotide of unknown sequence, the hybrid length is assumed to be that of the hybridizing polynucleotide. When polynucleotides of known sequence are hybridized, the hybrid length can be determined by aligning the sequences of the polynucleotides and identifying the region or regions of optimal sequence complementarity.
[H]SSPE (1xSSPE is 0.15M NaCl, 10 mM $NaH_2PO_4$, and 1.25 mM EDTA, pH 7.4) can be substituted for SSC (1xSSC is 0.15M NaCl and 15 mM sodium citrate) in the hybridization and wash buffers.
$T_B*$-$T_R*$The hybridization temperature for hybrids anticipated to be less than 50 base pairs in length should be 5-10° C. less than the melting temperature ($T_m$) of the hybrid, where $T_m$ is determined according to the following equations. For hybrids less than 18 base pairs in length, $T_m$(° C.) = 2(# of A + T bases) + 4(# of G + C bases). For hybrids between 18 and 49 base pairs in length, $T_m$(° C.) = 81.5 + 16.6($\log_{10}Na^+$) + 0.41(% G + C) − (600/N), where N is the number of bases in the hybrid, and $Na^+$ is the molar concentration of sodium ions in the hybridization buffer ($Na^+$ for 1xSSC = 0.165M).

Various aspects of the invention are described in further detail in the following sections and subsections. The use of sections and subsections is not meant to limit the invention; each section and subsection may apply to any aspect of the invention.

II. The Invention

The present invention provides methods for diagnosing RCC and other solid tumors by detecting gene expression patterns in peripheral blood. The present invention identifies a plurality of RCC disease genes which are differentially expressed in the peripheral blood of RCC patients compared to disease-free humans. At least a subset of these RCC disease genes is also differentially expressed in other solid tumors such as prostate cancer and head/neck cancer. Therefore, these genes can be used as surrogate markers for detecting the presence or absence of RCC and/or other solid tumors. In one embodiment, the expression patterns of these genes in peripheral blood can be determined by assessing the levels of RNA transcripts of these genes in peripheral blood samples. The peripheral blood samples may be the whole blood or blood samples containing enriched PBMCs. Suitable methods for detecting RNA levels include, but are not limited to, quantitative RT-PCT, Northern Blot, in situ hybridization, Southern Blot, slot-blotting, nuclease protection assay, and nucleic acid arrays. In another embodiment, the gene expression patterns can be determined by detecting the levels of polypeptides encoded by the solid tumor disease genes. Suitable methods include, but are not limited to, immunoassays such as ELISA (enzyme-linked immunosorbent assay), RIA (radioimmunoassay), FACS (fluorescence-activated cell sorter), or Western Blot. Methods based on 2-dimensional SDS-polyacrylamide gel electrophoresis can also be used.

A. General Methods for Identifying RCC and Solid Tumor Disease Genes in Peripheral Blood The availability of the human genome sequence, together with new developments in technology, such as DNA microarrays, proteomics and computational biology, allows systemic gene expression studies for various diseases. This invention employs the systematic gene expression analysis technique to identify genes and/or markers that are differentially expressed in the peripheral blood of patients with solid tumors such as RCC, prostate cancer, and head/neck cancer. These genes are herein referred to as "solid tumor disease genes." In particular, the genes that are differentially expressed in the peripheral blood of RCC patients compared to disease-free humans are referred to as "RCC disease genes."

Solid tumor disease genes are either over-expressed or under-expressed (including no expression) in the peripheral blood of solid tumor patients compared to disease-free humans. Therefore, solid tumor disease genes can be identified by comparing the gene expression patterns of solid tumor patients to the corresponding gene expression patterns of disease-free humans. Methods for detecting and comparing gene expression patterns are well known in the art.

In one embodiment, the gene expression patterns are detected by measuring the levels of RNA transcripts in the peripheral blood. For instance, total RNAs or polyA+ RNAs can be isolated from a peripheral blood sample. As used herein, a biological material, such as a polynucleotide, a polypeptide, a cell or a blood sample, is "isolated" if the biological material is removed from its native environment. For instance, a polynucleotide or a polypeptide can be isolated through a purification or extraction process. A blood sample can be isolated when it is removed from the human body.

The isolated RNAs are then amplified to produce cDNAs or cRNAs. The level of expression of a gene in the peripheral blood sample can be determined by measuring the amount of the corresponding cDNAs or cRNAs thus amplified.

One exemplary amplification protocol uses reverse transcriptase. For instance, isolated mRNAs can be first reverse transcribed into cDNAs using a reverse transcriptase, and a primer consisting of oligo d(T) and a sequence encoding the phage T7 promoter. The cDNAs thus produced are single-stranded. The second strands of the cDNAs are synthesized using a DNA polymerase, combined with an RNase to break up the DNA/RNA hybrid. After synthesis of the double-stranded cDNAs, T7 RNA polymerase is added, and cRNAs are then transcribed from the second strands of the doubled-stranded cDNAs.

In another embodiment, the gene expression patterns can be analyzed by measuring the levels of polypeptides in the peripheral blood. The amounts of polypeptides in a peripheral sample can be detected using various methods well known in the art. Suitable methods include, but are not limited to, immunoassays such as ELISA, RIA, FACS and Western Blot. High-throughput protein sequencing and identification methods can also be used, such as the methods based on two-dimensional gel electrophoresis and mass spectrometry.

In a preferred embodiment, the peripheral blood samples used for isolating RNA or polypeptides contain enriched or purified peripheral blood mononuclear cells (PBMCs). Methods for preparing blood samples with concentrated PBMCs are well known in the art. For instance, whole blood isolated from human subjects can be centrifuged through Ficoll gradients or CPTs (cell purification tubes), and the fraction containing enriched PBMCs is collected. "Enriched" means that the percentage of PBMCs in the sample is higher than the percentage of PBMCs in the initial whole blood. For instance, the percentage of PBMCs in the enriched sample can be at least 2, 3, 4, 5 or more times higher than that in the initial whole blood. In one embodiment, whole blood can be directly used to screen for solid tumor disease genes.

In another preferred embodiment, polynucleotide arrays, such as cDNA or oligonucleotide arrays, can be used to detect and/or compare the gene expression profiles in the peripheral blood of solid tumor patients versus disease-free humans. Polynucleotide arrays allow quantitative detecting and monitoring of the levels of RNA transcripts of a large number of genes at one time. Polynucleotide arrays suitable for this global gene expression analysis include, but are not limited to, commercially available arrays such as Genechip® arrays from Affymetrix (Santa Clara, Calif.) or cDNA microarrays from Agilent Technologies (Palo Alto, Calif.).

Polynucleotides to be hybridized to microarrays can be labeled with one or more labeling moieties to allow for detection of hybridized polynucleotide complexes. The labeling moieties can include compositions that can be detected by spectroscopic, photochemical, biochemical, bioelectronic, immunochemical, electrical, optical or chemical means. The labeling moieties include radioisotopes, chemiluminescent compounds, labeled binding proteins, heavy metal atoms, spectroscopic markers such as fluorescent markers and dyes, magnetic labels, linked enzymes, mass spectrometry tags, spin labels, electron transfer donors and acceptors, and the like. The polynucleotides to be hybridized to the microarrays can be either DNA or RNA.

Hybridization reactions can be performed in absolute or differential hybridization formats. In the absolute hybridization format, polynucleotides derived from one sample, such as a peripheral blood sample from a RCC patient or a disease-free human, are hybridized to the probes in a microarray. Signals detected after the formation of hybridization complexes correlate to the polynucleotide levels in the sample. In the differential hybridization format, polynucleotides derived from two biological samples, such as one from solid tumor patients and the other from disease-free humans, are labeled with different labeling moieties. A mixture of these differently labeled polynucleotides is added to a microarray. The microarray is then examined under conditions in which the emissions from the two different labels are individually detectable. In one embodiment, the fluorophores Cy3 and Cy5 (Amersham Pharmacia Biotech, Piscataway N.J.) are used as the labeling moieties for the differential hybridization format.

Signals gathered from microarrays can be analyzed using commercially available software, such as those provide by Affymetrix or Agilent Technologies. Controls, such as for scan sensitivity, probe labeling and cDNA quantitation, preferably are included in the hybridization experiments. The microarray expression signals can be scaled or normalized before being subject to further analysis. For instance, the expression signals for each gene can be normalized to take into account variations in hybridization intensities when more than one array is used under similar test conditions. Signals for individual polynucleotide complex hybridization can also be normalized using the intensities derived from internal normalization controls contained on each array. In addition, genes with relatively consistent expression levels across the samples can be used to normalize the expression levels of other genes. In one embodiment, the expression levels of the genes are normalized across the samples such that the mean is zero and the standard deviation is one. In another embodiment, the expression data detected by the microarray are subject to a variation filter which excludes genes showing minimal or insignificant variation across all samples.

The gene expression profiles in the peripheral blood samples of solid tumor patients can be compared to the corresponding gene expression profiles in the peripheral blood samples of disease-free humans. Genes that are differentially expressed in solid tumor patients relative to disease-free humans are identified. Preferably, the level of expression of a solid tumor disease gene is substantially higher or lower in solid tumor patients than in disease-free humans. "Substantially higher" means that the average expression level of a gene in the peripheral blood samples of solid tumor patients is at least 1.5 times over the average expression level of the gene in the peripheral blood samples of disease-free humans. For instance, the average expression level in solid tumor patients can be at least 2, 3, 4, 5, 10, 20, or more times over the average expression level in disease-free humans. "Substantially lower" means that the average expression level of a gene in the peripheral blood samples of solid tumor patients is no greater than 0.67 times over the average expression level of the gene in the peripheral blood samples of disease-free humans. For instance, the average expression level in solid tumor patients can be no greater than 0.5, 0.33, 0.25, 0.1, 0.05 or less times over the average expression level in disease-free humans.

In one embodiment, solid tumor disease genes can be identified using clustering algorithms based on the microarray gene expression data. For instance, unsupervised cluster analysis can be used to analyze and categorize genes with different expression patterns, thereby identifying solid tumor disease genes. Algorithms for unsupervised cluster analysis include, but are not limited to, self-organized maps (SOMs), principle component analysis, average linkage clustering, and hierarchical clustering.

Supervised cluster analysis can also be employed to organize and identify solid tumor disease genes. Under supervised cluster analysis, the disease status of the source from which a gene expression pattern is derived is already known. Algorithms for supervised cluster analysis include, but are not limited to, nearest neighbors test, support vector machines, and SPLASH. Either two-class or multi-class correlation metrics can be used.

In a preferred embodiment, a permutation test-based neighborhood analysis is used to analyze the microarray gene expression data in order to identify solid tumor disease genes. The algorithm for the neighborhood analysis is described in T. R. Golub, et al., Science, 286: 531-537 (1999), and D. K. Slonim et al., Procs. of the Fourth Annual International Conference on Computational Molecular Biology, Tokyo, Japan, April 8-11, p263-272 (2000), both of which are incorporated herein by reference.

Under one form of the neighborhood analysis, the expression profile of each gene is represented by an expression vector $g=(e_1, e_2, e_3, \ldots, e_n)$, where $e_i$ corresponds to the expression level of gene "g" in the ith sample. A class distinction is represented by an idealized expression pattern $c=(c_1, c_2, c_3, \ldots, c_n)$, where $c_i=1$ or $-1$, depending on whether the ith sample is isolated from class 0 or class 1. Class 0 may consist of patients with a particular solid tumor such as RCC, and class 1 may represent disease-free humans. Class 0 may also consist of patients with different solid tumors.

The correlation of gene "g" to the class distinction can be calculated using a signal-to-noise score:

$$P(g, c) = \frac{x0(g) - x1(g)}{sd0(g) + sd1(g)}$$

where $x0(g)$ and $x1(g)$ represent the means of the log of the expression level of gene "g" in class 0 and class 1, respectively, and $sd0(g)$ and $sd1(g)$ represent the standard deviation of the log of the expression of gene "g" in class 0 and class 1, respectively. A higher absolute value of a signal-to-noise score indicates that the corresponding gene is more highly expressed in one class than in the other. An unusually high density of genes within the neighborhoods of the class distinction, as compared to random patterns, suggests that many genes have expression patterns that are significantly correlated with the class distinction.

A plurality of solid tumor disease genes can be selected using the neighborhood analysis. In one embodiment, each solid tumor disease gene thus selected has a substantially higher or lower expression level in PBMCs of solid tumor patients than in PBMCs of disease-free humans. In another embodiment, the selected solid tumor disease genes have top absolute values of $P(g,c)$. In yet another embodiment, the selected solid tumor disease genes include both genes that are highly expressed in class 0 (such as RCC patients), and genes that are highly expressed in class 1 (such as disease-free humans). The solid tumor disease genes selected in the present invention can be involved in different biological pathways or mechanisms.

In one embodiment, the number of the selected solid tumor disease genes is limited to those shown to be significantly correlated by the permutation test, such as at the 1% or 2% significant level. As used herein, x % significant level means that x % of random neighborhoods contain as many genes as the real neighborhood around the class distinction.

The general methods for identifying solid tumor disease genes can be used to identify genes whose expression levels in the peripheral blood or PBMCs correlate with different stages of the development, progression or treatment of solid tumors. Patients can be grouped based on their different disease development or treatment stages. The global gene expression analysis can be employed to search for genes that are differentially expressed in one stage compared to another stage. The genes thus identified can be used as markers for monitoring the progression or treatment of solid tumors.

B. Identification of RCC Disease Genes

In one embodiment, HG-U95Av2 gene chips (manufactured by Affymetrix) are used for detecting and comparing the levels of RNA transcripts in PBMC-enriched peripheral blood samples prepared from RCC patients and disease-free humans. Table 2 lists examples of qualifiers on a HG-U95Av2 gene chip. Each qualifier represents multiple oligonucleotide probes that are stably attached to discrete regions on the gene chip. ATTACHMENT A, which is incorporated herein by reference, lists examples of qualifiers and their corresponding oligonucleotide probes. Each qualifier in Table 2 corresponds to at least one RCC disease gene which is differentially expressed in the peripheral blood of RCC patients compared to disease-free humans. In general, the corresponding RCC disease gene(s) of a qualifier can hybridize under stringent or nucleic acid array hybridization conditions to the oligonucleotide probes listed under the same qualifier in ATTACHMENT A.

The SEQ ID NO listed under each qualifier in Table 2 depicts a cDNA or genomic sequence, or the complement thereof, of the corresponding RCC disease gene(s). Fragments of the SEQ ID NO can be used to make oligonucleotide probes for detecting the RNA transcripts of the corresponding RCC disease gene(s). ATTACHMENT A includes some examples of the oligonucleotide probes thus made.

Each SEQ ID NO may have a corresponding Entrez Nucleotide Sequence Database accession number. The SEQ ID NOs and their corresponding accession numbers are illustrated in Table 3. The Entrez Nucleotide Sequence Database is maintained by the National Center of Biotechnology Information (NCBI), National Library of Medicine, Washington, D.C., U.S.A. The Database is publicly known and readily accessible. The Entrez Nucleotide Sequence Database contains sequence data from GenBank, EMBL and DDBJ. The sequence depicted under each SEQ ID NO can be derived from the sequence disclosed under the corresponding Entrez accession number.

The ambiguous nucleotide residues ("n") in the SEQ ID NOs can be determined using methods as appreciated by one of ordinary skill in the art. For instance, the ambiguous residues can be determined by aligning the SEQ ID NOs to their corresponding genes. The sequences of these genes can be obtained from various human genome sequence databases. The ambiguous nucleotide residues can also be determined by re-sequencing the corresponding SEQ ID NOs or the sequences under the corresponding Entrez accession numbers. Generally, each ambiguous position either represents at least one nucleotide selected from a, c, g, or t, or contains no nucleotide residue.

Each qualifier has a corresponding classification probe sequence (CPS) which is derived from the SEQ ID NO listed under the same qualifier. The corresponding CPS consists of at least part of the SEQ ID NO, or the complement thereof. Preferably, each CPS does not contain any ambiguous nucleotide residue. More preferably, each CPS comprises at least one oligonucleotide probe listed under the corresponding qualifier in ATTACHMENT A. Each CPS is capable of hybridizing under stringent or highly stringent conditions to the RNA transcripts of the RCC disease gene(s) represented by the corresponding qualifier. All of the CPSs listed in Table 2 are collectively referred to as "CPS-Table-2".

RNA transcripts, such as mRNAs, can be isolated from PBMC-enriched peripheral blood samples of RCC patients and disease-free humans. cRNAs can then be prepared using protocols described in the Affymetrix's Expression Analysis Technical Manuals. Subsection G of this specification provides detailed examples for sample preparation, HG-U95Av2 genechip hybridization, and subsequent data analysis.

A hybridization signal is collected for each oligonucleotide probe on the genechip. Signals for oligonucleotide probes with the same qualifier are averaged. Qualifiers that produce different hybridization signals in RCC samples relative to disease-free samples are identified. Examples of the identified qualifiers are listed in Table 2.

Each RCC expression profile in Table 2 ("Averaged Expression Level in RCC Patients") is an average of 45 RCC patients, while each expression profile for disease-free humans ("Averaged Expression Level in Disease-Free Humans") is an average of 20 disease-free humans. The averaged expression level under each qualifier in Table 2 represents the level of RNA transcripts of the corresponding RCC disease gene(s). The ratio of each RCC expression profile over the corresponding disease-free expression profile is provided under "Fold Change." The p-value of a Student's t-test (two-tailed distribution, two sample unequal variance) for each qualifier is also provided. The p-value suggests the statistical significance of the difference between each RCC expression profile and the corresponding disease-free expression profile. Lesser p-values indicate more statistical significance for the differences observed between RCC patients and disease-free humans.

TABLE 2

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 1 | 40310_at | nucleotides 2325 to 2635 of SEQ ID NO: 1 | 34.8 | 13.8 | 4.8E−10 | 2.5 |
| 2 | 41126_at | the complement of nucleotides 81 to 523 of SEQ ID NO: 2 | 5.71 | 2.7 | 1.9E−09 | 2.1 |
| 3 | 35367_at | nucleotides 61 to 865 of SEQ ID NO: 3 | 107 | 51.4 | 2.4E−09 | 2.1 |
| 4 | 41193_at | nucleotides 2095 to 2390 of SEQ ID NO: 4 | 26.2 | 8.2 | 2.7E−09 | 3.2 |
| 5 | 38829_r_at | SEQ ID NO: 5 | 19.7 | 7.9 | 5.0E−09 | 2.5 |
| 6 | 41102_at | nucleotides 1144 to 1607 of SEQ ID NO: 6 | 8.44 | 1.95 | 5.4E−09 | 4.3 |
| 7 | 40210_at | nucleotides 616 to 1159 of SEQ ID NO: 7 | 9.89 | 4.25 | 2.1E−08 | 2.3 |
| 8 | 37069_at | nucleotides 847 to 1236 of SEQ ID NO: 8 | 4.64 | 2.2 | 2.9E−08 | 2.1 |
| 9 | 39530_at | nucleotides 1129 to 1365 of SEQ ID NO: 9 | 8.51 | 4.15 | 3.0E−08 | 2.05 |
| 10 | 38739_at | nucleotides 46637 to 47224 of SEQ ID NO: 10 | 6.4 | 3 | 3.5E−08 | 2.1 |
| 11 | 32133_at | nucleotides 4460 to 5038 of SEQ ID NO: 11 | 12.9 | 4.45 | 3.7E−08 | 2.9 |
| 12 | 33873_at | nucleotides 950 to 1324 of SEQ ID NO: 12 | 15.7 | 6.9 | 4.5E−08 | 2.3 |
| 13 | 39854_r_at | nucleotides 988 to 1568 of SEQ ID NO: 13 | 34.6 | 14.05 | 5.5E−08 | 2.7 |
| 14 | 38546_at | nucleotides 4101 to 4542 of SEQ ID NO: 14 | 4.4 | 2.05 | 5.6E−08 | 2.1 |
| 15 | 1856_at | nucleotides 1544 to 1984 of SEQ ID NO: 15 | 8.47 | 3.7 | 5.8E−08 | 2.3 |
| 16 | 36892_at | nucleotides 3458 to 4037 of SEQ ID NO: 16 | 4.58 | 2.25 | 8.4E−08 | 2.0 |
| 17 | 37152_at | nucleotides 3047 to 3258 of SEQ ID NO: 17 | 8.47 | 3.5 | 9.9E−08 | 2.4 |
| 18 | 37603_at | nucleotides 1184 to 1653 of SEQ ID NO: 18 | 68.1 | 16.6 | 1.2E−07 | 4.1 |
| 19 | 37148_at | nucleotides 2098 to 2157 of SEQ ID NO: 19 | 41.2 | 18.25 | 1.8E−07 | 2.3 |
| 20 | 34740_at | SEQ ID NO: 20 | 65.1 | 22.25 | 1.8E−07 | 2.9 |
| 21 | 37747_at | nucleotides 127 to 557 of SEQ ID NO: 21 | 27.0 | 13.15 | 2.0E−07 | 2.05 |
| 22 | 36567_at | nucleotides 154 to 380 of SEQ ID NO: 22 | 6.02 | 2.8 | 2.1E−07 | 2.15 |
| 23 | 38956_at | nucleotides 688 to 1225 of SEQ ID NO: 23 | 4.56 | 2.1 | 2.8E−07 | 2.2 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/ Disease-Free) |
|---|---|---|---|---|---|---|
| 24 | 32207_at | nucleotides 1399 to 1771 of SEQ ID NO: 24 | 64.7 | 19.2 | 2.9E−07 | 3.4 |
| 25 | 36791_g_at | nucleotides 1002 to 1399 of SEQ ID NO: 25 | 7.62 | 3.65 | 3.0E−07 | 2.1 |
| 26 | 31684_at | nucleotides 812 to 1206 of SEQ ID NO: 26 | 5.73 | 2.85 | 3.2E−07 | 2.0 |
| 27 | 1401_g_at | nucleotides 2634 to 2981 of SEQ ID NO: 27 | 6.73 | 2.3 | 3.3E−07 | 2.9 |
| 28 | 37542_at | nucleotides 3676 to 4193 of SEQ ID NO: 28 | 8.8 | 2.35 | 3.5E−07 | 3.7 |
| 29 | 37966_at | the complement of nucleotides 34 to 320 of SEQ ID NO: 29 | 7.29 | 3.25 | 3.8E−07 | 2.2 |
| 30 | 38784_g_at | nucleotides 1231 to 1363 of SEQ ID NO: 30 | 7.51 | 2.75 | 4.1E−07 | 2.7 |
| 31 | 40331_at | nucleotides 1177 to 1673 of SEQ ID NO: 31 | 5.29 | 2 | 4.2E−07 | 2.6 |
| 32 | 40371_at | nucleotides 2127 to 2443 of SEQ ID NO: 32 | 12.0 | 3.55 | 4.3E−07 | 3.4 |
| 33 | 32339_at | the complement of nucleotides 9 to 433 of SEQ ID NO: 33 | 7.67 | 3.3 | 5.2E−07 | 2.3 |
| 34 | 34435_at | nucleotides 2300 to 2842 of SEQ ID NO: 34 | 23.4 | 9.4 | 6.6E−07 | 2.5 |
| 35 | 37136_at | nucleotides 1547 to 2068 of SEQ ID NO: 35 | 4.78 | 2.2 | 7.0E−07 | 2.2 |
| 36 | 37285_at | nucleotides 1344 to 1921 of SEQ ID NO: 36 | 370 | 54.1 | 7.0E−07 | 6.8 |
| 37 | 37391_at | nucleotides 1022 to 1395 of SEQ ID NO: 37 | 136 | 38.45 | 1.1E−06 | 3.5 |
| 38 | 35692_at | nucleotides 557 to 1078 of SEQ ID NO: 38 | 13.6 | 4.6 | 1.1E−06 | 3.0 |
| 39 | 38449_at | SEQ ID NO: 39 | 19.5 | 4.9 | 1.1E−06 | 4.0 |
| 40 | 37002_at | nucleotides 252 to 819 of SEQ ID NO: 40 | 42.2 | 11.05 | 1.2E−06 | 3.8 |
| 41 | 1139_at | nucleotides 813 to 1383 of SEQ ID NO: 41 | 10.8 | 4.95 | 1.3E−06 | 2.2 |
| 42 | 1622_at | nucleotides 1830 to 2074 of SEQ ID NO: 42 | 84.2 | 39.4 | 1.4E−06 | 2.1 |
| 43 | 32606_at | nucleotides 12 to 542 of SEQ ID NO: 43 | 15.8 | 7.7 | 1.4E−06 | 2.1 |
| 44 | 39436_at | nucleotides 926 to 1154 of SEQ ID NO: 44 | 82.3 | 24.3 | 1.7E−06 | 3.4 |
| 45 | 40274_at | nucleotides 561 to 736 of SEQ ID NO: 45 | 8.27 | 19.5 | 1.7E−06 | 0.42 |
| 46 | 37945_at | nucleotides 1179 to 1492 of SEQ ID NO: 46 | 8.13 | 3.85 | 1.9E−06 | 2.1 |
| 47 | 34255_at | nucleotides 1417 to 1798 of SEQ ID NO: 47 | 7.47 | 2.85 | 2.1E−06 | 2.6 |
| 48 | 905_at | nucleotides 268 to 814 of SEQ ID NO: 48 | 103 | 45.75 | 2.3E−06 | 2.3 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/ Disease-Free) |
|---|---|---|---|---|---|---|
| 49 | 1569_r_at | nucleotides 4183 to 4257 of SEQ ID NO: 49 | 9.27 | 4.45 | 2.5E−06 | 2.1 |
| 50 | 41125_r_at | SEQ ID NO: 50 | 5.2 | 2.2 | 3.0E−06 | 2.4 |
| 51 | 35256_at | nucleotides 1781 to 2279 of SEQ ID NO: 51 | 75.9 | 28.95 | 3.0E−06 | 2.6 |
| 52 | 290_s_at | nucleotides 620 to 1233 of SEQ ID NO: 52 | 9.38 | 3.55 | 3.2E−06 | 2.6 |
| 53 | 34666_at | nucleotides 755 to 1026 of SEQ ID NO: 53 | 11.3 | 4.45 | 4.0E−06 | 2.5 |
| 54 | 34689_at | nucleotides 713 to 1179 of SEQ ID NO: 54 | 9.31 | 2.9 | 4.0E−06 | 3.2 |
| 55 | 2090_i_at | nucleotides 2 to 36 of SEQ ID NO: 55 | 54.4 | 26.2 | 4.1E−06 | 2.1 |
| 56 | 37412_at | nucleotides 1319 to 1692 of SEQ ID NO: 56 | 8.27 | 3.25 | 4.1E−06 | 2.5 |
| 57 | 39799_at | nucleotides 409 to 662 of SEQ ID NO: 57 | 24.6 | 7.2 | 4.2E−06 | 3.4 |
| 58 | 31859_at | nucleotides 1756 to 2123 of SEQ ID NO: 58 | 6.31 | 2.7 | 4.6E−06 | 2.3 |
| 59 | 37661_at | nucleotides 4061 to 4398 of SEQ ID NO: 59 | 19.5 | 8.35 | 4.8E−06 | 2.3 |
| 60 | 36393_at | nucleotides 806 to 1398 of SEQ ID NO: 60 | 5.69 | 2.7 | 5.0E−06 | 2.1 |
| 61 | 39994_at | nucleotides 1878 to 2214 of SEQ ID NO: 61 | 10.0 | 4 | 5.1E−06 | 2.5 |
| 62 | 35597_at | nucleotides 282 to 675 of SEQ ID NO: 62 | 5.22 | 2.35 | 5.3E−06 | 2.2 |
| 63 | 36780_at | nucleotides 1236 to 1651 of SEQ ID NO: 63 | 172 | 79.95 | 5.7E−06 | 2.15 |
| 64 | 34476_r_at | nucleotides 4012 to 4358 of SEQ ID NO: 64 | 11 | 3.5 | 5.7E−06 | 3.1 |
| 65 | 33862_at | nucleotides 1027 to 1445 of SEQ ID NO: 65 | 3.91 | 1.85 | 5.7E−06 | 2.1 |
| 66 | 956_at | SEQ ID NO: 66 | 23.0 | 8.7 | 5.8E−06 | 2.6 |
| 67 | 40769_r_at | nucleotides 6070 to 6132 of SEQ ID NO: 67 | 22.9 | 10.35 | 6.3E−06 | 2.2 |
| 68 | 41790_at | nucleotides 80268 to 80822 of SEQ ID NO: 68 | 4.2 | 1.8 | 6.6E−06 | 2.3 |
| 69 | 40456_at | nucleotides 733 to 1310 of SEQ ID NO: 69 | 11.3 | 5.15 | 6.8E−06 | 2.2 |
| 70 | 40647_at | nucleotides 4621 to 5041 of SEQ ID NO: 70 | 17.4 | 5.85 | 7.4E−06 | 3.0 |
| 71 | 31834_r_at | nucleotides 4249 to 4499 of SEQ ID NO: 71 | 5.78 | 2.85 | 7.8E−06 | 2.0 |
| 72 | 38119_at | nucleotides 437 to 935 of SEQ ID NO: 72 | 137 | 60.95 | 8.1E−06 | 2.3 |
| 73 | 1670_at | nucleotides 977 to 1421 of SEQ ID NO: 73 | 3.62 | 1.8 | 8.1E−06 | 2.0 |
| 74 | 1649_at | nucleotides 384 to 651 of SEQ ID NO: 74 | 10.5 | 4.4 | 8.1E−06 | 2.4 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 75 | 38868_at | nucleotides 205 to 808 of SEQ ID NO: 75 | 7.82 | 3.25 | 9.3E−06 | 2.4 |
| 76 | 37952_at | nucleotides 3852 to 4432 of SEQ ID NO: 76 | 13.4 | 5.25 | 1.0E−05 | 2.6 |
| 77 | 654_at | nucleotides 1905 to 2355 of SEQ ID NO: 77 | 65.4 | 21.35 | 1.1E−05 | 3.1 |
| 78 | 39839_at | nucleotides 1398 to 1568 of SEQ ID NO: 78 | 70.2 | 16.3 | 1.2E−05 | 4.3 |
| 79 | 41743_i_at | nucleotides 1613 to 2103 of SEQ ID NO: 79 | 10.4 | 4.1 | 1.2E−05 | 2.5 |
| 80 | 37405_at | nucleotides 1113 to 1429 of SEQ ID NO: 80 | 140 | 20.3 | 1.2E−05 | 6.9 |
| 81 | 936_s_at | nucleotides 60 to 556 of SEQ ID NO: 81 | 12.0 | 3.95 | 1.3E−05 | 3.0 |
| 82 | 37323_r_at | nucleotides 130 to 517 of SEQ ID NO: 82 | 5.09 | 2.25 | 1.6E−05 | 2.3 |
| 83 | 33336_at | SEQ ID NO: 83 | 58.0 | 7.75 | 1.7E−05 | 7.5 |
| 84 | 36229_at | nucleotides 2518 to 2844 of SEQ ID NO: 84 | 3.84 | 1.9 | 1.8E−05 | 2.0 |
| 87 | 41442_at | nucleotides 3614 to 4179 of SEQ ID NO: 85 | 8.69 | 2.55 | 2.1E−05 | 3.4 |
| 89 | 33080_s_at | nucleotides 5056 to 5248 of SEQ ID NO: 86 | 170 | 51.95 | 2.1E−05 | 3.3 |
| 90 | 34742_at | nucleotides 774 to 926 of SEQ ID NO: 87 | 14.3 | 3.35 | 2.2E−05 | 4.3 |
| 91 | 37026_at | nucleotides 803 to 1325 of SEQ ID NO: 88 | 54.3 | 24.9 | 2.2E−05 | 2.2 |
| 92 | 34777_at | nucleotides 901 to 1449 of SEQ ID NO: 89 | 50.3 | 20.15 | 2.3E−05 | 2.5 |
| 93 | 36037_g_at | nucleotides 6396 to 6496 of SEQ ID NO: 90 | 13 | 2.35 | 2.4E−05 | 5.5 |
| 94 | 40644_g_at | nucleotides 2734 to 2853 of SEQ ID NO: 91 | 19.7 | 6.35 | 2.4E−05 | 3.1 |
| 95 | 35331_at | nucleotides 2038 to 2395 of SEQ ID NO: 92 | 5.16 | 2.2 | 2.6E−05 | 2.3 |
| 96 | 875_g_at | nucleotides 562 to 886 of SEQ ID NO: 93 | 98 | 14.75 | 3.2E−05 | 6.6 |
| 97 | 35773_i_at | the complement of nucleotides 98 to 398 of SEQ ID NO: 94 | 21.0 | 5.7 | 3.3E−05 | 3.7 |
| 98 | 39802_at | nucleotides 444 to 991 of SEQ ID NO: 95 | 18.9 | 5.2 | 3.4E−05 | 3.6 |
| 99 | 37220_at | nucleotides 150 to 425 of SEQ ID NO: 96 | 8.67 | 4.05 | 3.9E−05 | 2.1 |
| 100 | 37192_at | nucleotides 2337 to 2715 of SEQ ID NO: 97 | 94.8 | 23.6 | 3.9E−05 | 4.0 |
| 101 | 31610_at | nucleotides 224 to 512 of SEQ ID NO: 98 | 18.4 | 7.95 | 3.9E−05 | 2.3 |
| 102 | 37104_at | nucleotides 1227 to 1673 of SEQ ID NO: 99 | 17.4 | 2.85 | 4.0E−05 | 6.1 |
| 103 | 38582_at | the complement of nucleotides 40 to 288 of SEQ ID NO: 100 | 5.58 | 2 | 4.1E−05 | 2.8 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/ Disease-Free) |
|---|---|---|---|---|---|---|
| 104 | 41169_at | nucleotides 890 to 1006 of SEQ ID NO: 101 | 6.22 | 2.25 | 4.2E−05 | 2.8 |
| 105 | 1274_s_at | nucleotides 741 to 899 of SEQ ID NO: 102 | 20.6 | 5.85 | 4.3E−05 | 3.5 |
| 106 | 40177_at | the complement of nucleotides 67 to 276 of SEQ ID NO: 103 | 3.93 | 1.85 | 4.6E−05 | 2.1 |
| 107 | 35659_at | nucleotides 3019 to 3325 of SEQ ID NO: 104 | 19.2 | 40.25 | 4.8E−05 | 0.48 |
| 108 | 35337_at | nucleotides 1596 to 2056 of SEQ ID NO: 105 | 124 | 52.85 | 4.9E−05 | 2.3 |
| 109 | 38584_at | nucleotides 1459 to 1700 of SEQ ID NO: 106 | 9.18 | 4.45 | 5.0E−05 | 2.1 |
| 110 | 1997_s_at | nucleotides 325 to 388 of SEQ ID NO: 107 | 4.2 | 8.65 | 5.2E−05 | 0.49 |
| 111 | 36162_at | nucleotides 1062 to 1560 of SEQ ID NO: 108 | 37.2 | 10.25 | 5.2E−05 | 3.6 |
| 112 | 867_s_at | nucleotides 1820 to 1945 of SEQ ID NO: 109 | 11.3 | 3.9 | 5.5E−05 | 2.9 |
| 113 | 38799_at | nucleotides 2706 to 2791 of SEQ ID NO: 110 | 7.62 | 1.85 | 5.6E−05 | 4.1 |
| 115 | 36628_at | nucleotides 3321 to 3804 of SEQ ID NO: 111 | 11.1 | 5.55 | 6.2E−05 | 2.0 |
| 116 | 34545_at | nucleotides 1003 to 1158 of SEQ ID NO: 112 | 8.13 | 3.65 | 6.4E−05 | 2.2 |
| 117 | 31346_at | nucleotides 647 to 1187 of SEQ ID NO: 113 | 6.64 | 2.7 | 6.4E−05 | 2.5 |
| 118 | 40926_at | nucleotides 13656 to 14081 of SEQ ID NO: 114 | 18.1 | 6.8 | 6.5E−05 | 2.7 |
| 119 | 33803_at | nucleotides 3479 to 4005 of SEQ ID NO: 115 | 34.5 | 16.15 | 6.8E−05 | 2.1 |
| 120 | 296_at | SEQ ID NO: 116 | 15.0 | 6.55 | 6.9E−05 | 2.3 |
| 123 | 41617_at | the complement of nucleotides 41 to 485 of SEQ ID NO: 117 | 8.42 | 2.8 | 8.6E−05 | 3.0 |
| 125 | 1774_at | nucleotides 497 to 845 of SEQ ID NO: 118 | 5.93 | 2.55 | 8.8E−05 | 2.3 |
| 126 | 40990_at | nucleotides 1006 to 1405 of SEQ ID NO: 119 | 8.29 | 3.45 | 8.8E−05 | 2.4 |
| 127 | 34798_at | nucleotides 732 to 1259 of SEQ ID NO: 120 | 39.8 | 15.55 | 8.9E−05 | 2.6 |
| 128 | 35674_at | nucleotides 3798 to 4194 of SEQ ID NO: 121 | 6.69 | 2.9 | 9.7E−05 | 2.3 |
| 129 | 1368_at | nucleotides 4459 to 4885 of SEQ ID NO: 122 | 14.6 | 6.2 | 9.8E−05 | 2.4 |
| 130 | 430_at | nucleotides 444 to 960 of SEQ ID NO: 123 | 18 | 8.9 | 0.00010 | 2.0 |
| 131 | 39248_at | the complement of nucleotides 55 to 344 of SEQ ID NO: 124 | 17.8 | 47 | 0.00010 | 0.38 |
| 132 | 33932_at | nucleotides 2013 to 2558 of SEQ ID NO: 125 | 28.4 | 10.1 | 0.00011 | 2.8 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 133 | 35767_at | the complement of nucleotides 59 to 621 of SEQ ID NO: 126 | 60.1 | 27.55 | 0.00011 | 2.2 |
| 134 | 33516_at | SEQ ID NO: 127 | 149 | 23.2 | 0.00011 | 6.4 |
| 135 | 40120_at | nucleotides 426 to 948 of SEQ ID NO: 128 | 31.9 | 7.5 | 0.00011 | 4.3 |
| 136 | 31380_at | nucleotides 3015 to 3534 of SEQ ID NO: 129 | 10.4 | 4.9 | 0.00012 | 2.1 |
| 137 | 35379_at | nucleotides 2491 to 2893 of SEQ ID NO: 130 | 18.7 | 7.4 | 0.00013 | 2.5 |
| 138 | 38138_at | nucleotides 133 to 574 of SEQ ID NO: 131 | 28.6 | 12.15 | 0.00013 | 2.4 |
| 139 | 355_s_at | nucleotides 250 to 850 of SEQ ID NO: 132 | 4.96 | 2.3 | 0.00013 | 2.2 |
| 141 | 36045_at | SEQ ID NO: 133 | 4.31 | 1.8 | 0.00014 | 2.4 |
| 142 | 39145_at | nucleotides 647 to 1120 of SEQ ID NO: 134 | 5.98 | 1.8 | 0.00016 | 3.3 |
| 143 | 39423_f_at | nucleotides 1589 to 1642 of SEQ ID NO: 135 | 6 | 2.95 | 0.00017 | 2.0 |
| 144 | 38598_at | the complement of nucleotides 149 to 213 of SEQ ID NO: 136 | 8.84 | 3.5 | 0.00017 | 2.5 |
| 145 | 33799_at | nucleotides 1981 to 2240 of SEQ ID NO: 137 | 29.6 | 13.85 | 0.00017 | 2.1 |
| 146 | 34319_at | nucleotides 39 to 419 of SEQ ID NO: 138 | 22.9 | 9.55 | 0.00017 | 2.4 |
| 147 | 36113_s_at | nucleotides 14630 to 14687 of SEQ ID NO: 139 | 4.13 | 2.05 | 0.00019 | 2.0 |
| 148 | 40848_g_at | nucleotides 3447 to 3808 of SEQ ID NO: 140 | 14.6 | 2.95 | 0.00019 | 4.9 |
| 149 | 2094_s_at | nucleotides 2713 to 3294 of SEQ ID NO: 141 | 66.6 | 136 | 0.00020 | 0.49 |
| 150 | 37185_at | nucleotides 1311 to 1761 of SEQ ID NO: 142 | 226 | 84.55 | 0.00020 | 2.7 |
| 151 | 35714_at | nucleotides 642 to 960 of SEQ ID NO: 143 | 7.71 | 3.2 | 0.00021 | 2.4 |
| 152 | 40951_at | nucleotides 1860 to 2099 of SEQ ID NO: 144 | 5.27 | 2.3 | 0.00022 | 2.3 |
| 153 | 37187_at | nucleotides 504 to 946 of SEQ ID NO: 145 | 59.1 | 19.55 | 0.00023 | 3.0 |
| 154 | 33506_at | nucleotides 2672 to 3121 of SEQ ID NO: 146 | 7.07 | 2.2 | 0.00023 | 3.2 |
| 155 | 34430_at | nucleotides 2931 to 3119 of SEQ ID NO: 147 | 12.6 | 6.1 | 0.00025 | 2.1 |
| 156 | 40062_s_at | SEQ ID NO: 148 | 9.36 | 2.35 | 0.00027 | 4.0 |
| 157 | 37179_at | nucleotides 1069 to 1648 of SEQ ID NO: 149 | 10.1 | 3.15 | 0.00028 | 3.2 |
| 158 | 1486_at | nucleotides 145 to 529 of SEQ ID NO: 150 | 5.22 | 1.8 | 0.00028 | 2.9 |
| 159 | 40182_s_at | nucleotides 1849 to 2085 of SEQ ID NO: 151 | 5.73 | 2.7 | 0.00029 | 2.1 |
| 160 | 36419_at | nucleotides 850 to 1028 of SEQ ID NO: 152 | 4.22 | 1.8 | 0.00029 | 2.3 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 161 | 32581_at | SEQ ID NO: 153 | 4.24 | 2 | 0.00035 | 2.1 |
| 162 | 31308_at | nucleotides 36 to 484 of SEQ ID NO: 154 | 4 | 1.8 | 0.00039 | 2.2 |
| 163 | 36871_at | nucleotides 2087 to 2652 of SEQ ID NO: 155 | 14.2 | 2.55 | 0.00037 | 5.5 |
| 164 | 40956_at | nucleotides 2649 to 3183 of SEQ ID NO: 156 | 12.9 | 5.25 | 0.00038 | 2.45 |
| 165 | 35151_at | nucleotides 436 to 895 of SEQ ID NO: 157 | 4.18 | 1.9 | 0.00039 | 2.2 |
| 166 | 39543_at | the complement of nucleotides 106 to 619 of SEQ ID NO: 158 | 7.51 | 3.3 | 0.00041 | 2.3 |
| 167 | 725_i_at | nucleotides 1844 to 2146 of SEQ ID NO: 159 | 11.5 | 29.8 | 0.00043 | 0.39 |
| 168 | 31454_f_at | nucleotides 878 to 972 of SEQ ID NO: 160 | 5.6 | 2.55 | 0.00047 | 2.2 |
| 169 | 40366_at | nucleotides 2709 to 3063 of SEQ ID NO: 161 | 13.5 | 4.4 | 0.00048 | 3.1 |
| 170 | 1251_g_at | nucleotides 3043 to 3230 of SEQ ID NO: 162 | 8.53 | 2.45 | 0.00048 | 3.5 |
| 171 | 115_at | nucleotides 3083 to 3605 of SEQ ID NO: 163 | 42.2 | 17.25 | 0.00049 | 2.4 |
| 172 | 34447_at | nucleotides 2881 to 3318 of SEQ ID NO: 164 | 6.58 | 2.35 | 0.00050 | 2.8 |
| 173 | 38879_at | nucleotides 19 to 325 of SEQ ID NO: 165 | 40.0 | 17.25 | 0.00050 | 2.3 |
| 174 | 39389_at | nucleotides 686 to 1058 of SEQ ID NO: 166 | 14.9 | 7.4 | 0.00054 | 2.0 |
| 175 | 39729_at | nucleotides 712 to 968 of SEQ ID NO: 167 | 25.4 | 8.4 | 0.00057 | 3.0 |
| 176 | 39448_r_at | nucleotides 46 to 468 of SEQ ID NO: 168 | 8.07 | 16.45 | 0.00058 | 0.49 |
| 177 | 33759_at | nucleotides 1090 to 1582 of SEQ ID NO: 169 | 17.0 | 5 | 0.00059 | 3.4 |
| 178 | 33449_at | nucleotides 893 to 969 of SEQ ID NO: 170 | 10.5 | 5 | 0.00060 | 2.1 |
| 179 | 31812_at | nucleotides 1047 to 1464 of SEQ ID NO: 171 | 32.2 | 12.55 | 0.00061 | 2.6 |
| 180 | 40578_s_at | nucleotides 2081 to 2425 of SEQ ID NO: 172 | 12.1 | 2.45 | 0.00078 | 4.9 |
| 181 | 40766_at | SEQ ID NO: 173 | 11.4 | 4.25 | 0.00079 | 2.7 |
| 182 | 31320_at | nucleotides 631 to 1169 of SEQ ID NO: 174 | 3.84 | 1.8 | 0.00081 | 2.1 |
| 183 | 34378_at | nucleotides 1217 to 1314 of SEQ ID NO: 175 | 102 | 28.2 | 0.00092 | 3.6 |
| 184 | 40773_at | nucleotides 37 to 522 of SEQ ID NO: 176 | 9.56 | 3.15 | 0.0010 | 3.0 |
| 185 | 38726_at | the complement of nucleotides 125 to 494 of SEQ ID NO: 177 | 20.8 | 3.6 | 0.0010 | 5.8 |
| 186 | 1832_at | nucleotides 3598 to 4132 of SEQ ID NO: 178 | 5.00 | 2.05 | 0.0010 | 2.4 |
| 187 | 36543_at | nucleotides 1723 to 2013 of SEQ ID NO: 179 | 6.87 | 1.95 | 0.0011 | 3.5 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 188 | 137_at | nucleotides 1138 to 1564 of SEQ ID NO: 180 | 6.02 | 1.8 | 0.0012 | 3.3 |
| 189 | 38585_at | SEQ ID NO: 181 | 258 | 74.25 | 0.0012 | 3.5 |
| 190 | 34022_at | nucleotides 426 to 993 of SEQ ID NO: 182 | 32.2 | 4.25 | 0.0012 | 7.6 |
| 191 | 38021_at | nucleotides 14286 to 14757 of SEQ ID NO: 183 | 5.67 | 2.25 | 0.0013 | 2.5 |
| 192 | 33143_s_at | nucleotides 1523 to 1918 of SEQ ID NO: 184 | 18.7 | 6.1 | 0.0015 | 3.1 |
| 194 | 40850_at | nucleotides 1048 to 1504 of SEQ ID NO: 185 | 16.9 | 4.1 | 0.0016 | 4.1 |
| 195 | 36766_at | nucleotides 167 to 666 of SEQ ID NO: 186 | 24.5 | 11.3 | 0.0017 | 2.2 |
| 196 | 38201_at | nucleotides 836 to 1155 of SEQ ID NO: 187 | 7.18 | 3.05 | 0.0018 | 2.4 |
| 199 | 2092_s_at | nucleotides 824 to 1229 of SEQ ID NO: 188 | 9.78 | 2.35 | 0.0022 | 4.2 |
| 201 | 408_at | nucleotides 1229 to 1851 of SEQ ID NO: 189 | 21.1 | 2.4 | 0.0028 | 8.8 |
| 202 | 36058_at | nucleotides 1083 to 1550 of SEQ ID NO: 190 | 29.6 | 11.7 | 0.0030 | 2.5 |
| 205 | 38429_at | nucleotides 7939 to 8395 of SEQ ID NO: 192 | 5.00 | 2.4 | 0.0035 | 2.1 |
| 206 | 502_s_at | nucleotides 1959 to 2156 of SEQ ID NO: 193 | 5.18 | 1.85 | 0.0041 | 2.8 |
| 207 | 33802_at | nucleotides 51072 to 51587 of SEQ ID NO: 194 | 21.4 | 10.25 | 0.0047 | 2.1 |
| 208 | 38010_at | nucleotides 1044 to 1494 of SEQ ID NO: 195 | 6.58 | 3.25 | 0.0050 | 2.0 |
| 209 | 41046_s_at | nucleotides 5551 to 6046 of SEQ ID NO: 196 | 4.76 | 2.2 | 0.0068 | 2.2 |
| 210 | 39095_at | nucleotides 5774 to 5945 of SEQ ID NO: 197 | 5.87 | 1.8 | 0.0072 | 3.3 |
| 211 | 39402_at | nucleotides 927 to 1473 of SEQ ID NO: 198 | 71.6 | 18.45 | 0.0073 | 3.9 |
| 212 | 37184_at | nucleotides 1631 to 2037 of SEQ ID NO: 199 | 6.36 | 2.7 | 0.0074 | 2.4 |
| 213 | 38273_at | nucleotides 1251 to 1576 of SEQ ID NO: 200 | 6.47 | 2.5 | 0.0075 | 2.6 |
| 214 | 35894_at | nucleotides 1736 to 2016 of SEQ ID NO: 201 | 4.67 | 1.8 | 0.0076 | 2.6 |
| 215 | 33429_at | nucleotides 937 to 1538 of SEQ ID NO: 202 | 6.38 | 2.6 | 0.0083 | 2.5 |
| 216 | 558_at | nucleotides 5446 to 5866 of SEQ ID NO: 203 | 36.8 | 11.3 | 0.0084 | 3.3 |
| 217 | 41575_at | nucleotides 2056 to 2530 of SEQ ID NO: 204 | 5.09 | 2.15 | 0.0086 | 2.4 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 218 | 39780_at | nucleotides 2550 to 3078 of SEQ ID NO: 205 | 5.2 | 2.6 | 0.0094 | 2 |
| 219 | 1257_s_at | nucleotides 2590 to 2840 of SEQ ID NO: 206 | 33.6 | 14.35 | 0.0095 | 2.3 |
| 220 | 32904_at | SEQ ID NO: 207 | 8.78 | 20.85 | 0.0096 | 0.42 |
| 221 | 31499_s_at | nucleotides 251 to 854 of SEQ ID NO: 208 | 16.0 | 6.6 | 0.010 | 2.4 |
| 222 | 1069_at | nucleotides 8872 to 9184 of SEQ ID NO: 209 | 7.82 | 2.95 | 0.011 | 2.7 |
| 223 | 39413_at | nucleotides 6717 to 6771 of SEQ ID NO: 210 | 4.91 | 1.8 | 0.012 | 2.7 |
| 224 | 34281_at | nucleotides 1207 to 1559 of SEQ ID NO: 211 | 9.4 | 3.4 | 0.012 | 2.8 |
| 225 | 33914_r_at | SEQ ID NO: 212 | 19.6 | 2.15 | 0.012 | 9.1 |
| 226 | 35762_at | nucleotides 4753 to 5179 of SEQ ID NO: 213 | 8.89 | 2.8 | 0.013 | 3.2 |
| 227 | 36372_at | nucleotides 2437 to 3029 of SEQ ID NO: 214 | 6.78 | 2.95 | 0.013 | 2.3 |
| 228 | 32451_at | nucleotides 1020 to 1387 of SEQ ID NO: 215 | 6.31 | 1.95 | 0.013 | 3.2 |
| 229 | 40385_at | nucleotides 207 to 742 of SEQ ID NO: 216 | 6.93 | 2.35 | 0.014 | 3.0 |
| 230 | 35036_at | nucleotides 2895 to 3261 of SEQ ID NO: 217 | 5.4 | 2.1 | 0.014 | 2.6 |
| 231 | 34014_f_at | nucleotides 664 to 1000 of SEQ ID NO: 218 | 8.38 | 2.15 | 0.015 | 3.9 |
| 232 | 37120_at | nucleotides 1870 to 2379 of SEQ ID NO: 219 | 12.2 | 3.45 | 0.016 | 3.5 |
| 234 | 32054_at | nucleotides 1916 to 2038 of SEQ ID NO: 220 | 6.13 | 2.3 | 0.017 | 2.7 |
| 235 | 33742_f_at | nucleotides 248 to 367 of SEQ ID NO: 221 | 8.09 | 1.8 | 0.019 | 4.5 |
| 236 | 31719_at | nucleotides 7039 to 7633 of SEQ ID NO: 222 | 3.64 | 1.8 | 0.020 | 2.0 |
| 237 | 35418_at | nucleotides 471 to 714 of SEQ ID NO: 223 | 11.8 | 1.85 | 0.021 | 6.4 |
| 239 | 1407_g_at | nucleotides 1768 to 1958 of SEQ ID NO: 224 | 7.11 | 2.95 | 0.022 | 2.4 |
| 240 | 31666_f_at | nucleotides 62 to 339 of SEQ ID NO: 225 | 13.8 | 1.8 | 0.024 | 7.7 |
| 241 | 38299_at | nucleotides 728 to 1053 of SEQ ID NO: 226 | 23.9 | 3 | 0.025 | 8.0 |
| 242 | 40517_at | nucleotides 5232 to 5667 of SEQ ID NO: 227 | 7.84 | 3.05 | 0.025 | 2.6 |
| 243 | 1350_at | nucleotides 2099 to 2350 of SEQ ID NO: 228 | 7.8 | 2.85 | 0.026 | 2.7 |
| 244 | 207_at | nucleotides 1512 to 2082 of SEQ ID NO: 229 | 9.07 | 3.45 | 0.028 | 2.6 |
| 245 | 39166_s_at | nucleotides 1583 to 1790 of SEQ ID NO: 230 | 8.42 | 2.75 | 0.030 | 3.1 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/Disease-Free) |
|---|---|---|---|---|---|---|
| 246 | 31574_i_at | nucleotides 39 to 78 of SEQ ID NO: 231 | 16.8 | 1.8 | 0.034 | 9.3 |
| 247 | 40159_r_at | nucleotides 970 to 1341 of SEQ ID NO: 232 | 20.2 | 8.7 | 0.035 | 2.3 |
| 248 | 33244_at | SEQ ID NO: 233 | 9.29 | 3.75 | 0.037 | 2.5 |
| 249 | 2041_i_at | nucleotides 3736 to 3773 of SEQ ID NO: 234 | 66.5 | 2.35 | 0.038 | 28 |
| 250 | 40635_at | nucleotides 1460 to 1771 of SEQ ID NO: 235 | 12.9 | 5.5 | 0.039 | 2.3 |
| 251 | 38908_s_at | nucleotides 2043 to 2283 of SEQ ID NO: 236 | 20.3 | 5.65 | 0.039 | 3.6 |
| 252 | 732_f_at | SEQ ID NO: 237 | 21.4 | 8.5 | 0.042 | 2.5 |
| 253 | 32579_at | nucleotides 5059 to 5246 of SEQ ID NO: 238 | 40.1 | 7.75 | 0.043 | 5.2 |
| 254 | 33021_at | nucleotides 1744 to 1878 of SEQ ID NO: 239 | 8.42 | 4.2 | 0.047 | 2.0 |
| 255 | 35175_f_at | nucleotides 1252 to 1447 of SEQ ID NO: 285 | 118.47 | 191.35 | 4.4E-10 | 0.62 |
| 256 | 32587_at | nucleotides 4939 to 5425 of SEQ ID NO: 286 | 61.16 | 117.80 | 5.2E-10 | 0.52 |
| 257 | 37337_at | the complement of nucleotides 7 to 362 of SEQ ID NO: 287 | 14.04 | 23.55 | 5.2E-10 | 0.60 |
| 258 | 329_s_at | SEQ ID NO: 288 | 8.44 | 16.00 | 3.0E-10 | 0.53 |
| 259 | 36589_at | nucleotides 797 to 1192 of SEQ ID NO: 289 | 15.78 | 23.25 | 1.7E-08 | 0.68 |
| 260 | 33828_at | SEQ ID NO: 328 | 13.07 | 20.10 | 6.7E-08 | 0.65 |
| 261 | 41787_at | the complement of nucleotides 77 to 413 of SEQ ID NO: 291 | 6.04 | 3.50 | 2.1E-08 | 1.73 |
| 262 | 41220_at | nucleotides 3638 to 3874 of SEQ ID NO: 292 | 169.69 | 227.65 | 3.8E-07 | 0.75 |
| 263 | 38590_r_at | nucleotides 575 to 1111 of SEQ ID NO: 293 | 201.78 | 274.50 | 1.4E-07 | 0.74 |
| 264 | 40018_at | nucleotides 5780 to 6213 of SEQ ID NO: 294 | 7.84 | 4.45 | 2.4E-07 | 1.76 |
| 265 | 39155_at | nucleotides 1548 to 2085 of SEQ ID NO: 295 | 19.22 | 25.80 | 3.9E-08 | 0.75 |
| 266 | 37668_at | nucleotides 600 to 948 of SEQ ID NO: 296 | 10.80 | 17.95 | 2.9E-11 | 0.60 |
| 267 | 39136_at | nucleotides 4031 to 4415 of SEQ ID NO: 297 | 15.33 | 10.55 | 3.7E-06 | 1.45 |
| 268 | 1125_s_at | nucleotides 43 to 226 of SEQ ID NO: 298 | 8.42 | 4.50 | 5.7E-08 | 1.87 |
| 269 | 1211_s_at | nucleotides 972 to 1076 of SEQ ID NO: 299 | 7.02 | 3.80 | 4.5E-07 | 1.85 |
| 270 | 1445_at | nucleotides 1097 to 1643 of SEQ ID NO: 300 | 6.47 | 3.55 | 3.6E-07 | 1.82 |
| 271 | 32405_at | nucleotides 5804 to 6242 of SEQ ID NO: 301 | 7.69 | 4.50 | 2.9E-07 | 1.71 |
| 272 | 32635_at | nucleotides 3240 to 3424 of SEQ ID NO: 302 | 8.00 | 4.65 | 6.9E-05 | 1.72 |

TABLE 2-continued

Comparison of Gene Expression Levels Between RCC Patients and Disease-Free Humans

| CPS No. | Qualifier | CPS | Averaged Expression Level in RCC Patients (n = 45) | Averaged Expression Level in Disease-Free Humans (n = 20) | t-test p-value | Fold Change (RCC/ Disease-Free) |
|---|---|---|---|---|---|---|
| 273 | 36331_at | nucleotides 2550 to 3110 of SEQ ID NO: 303 | 6.42 | 3.30 | 7.2E−07 | 1.95 |
| 274 | 37788_at | nucleotides 1293–1655 of SEQ ID NO: 304 | 4.62 | 2.35 | 1.2E−05 | 1.97 |
| 275 | 38228_g_at | nucleotides 1878 to 2045 of SEQ ID NO: 305 | 6.53 | 4.25 | 5.4E−05 | 1.54 |
| 276 | 39708_at | SEQ ID NO: 306 | 32.13 | 19.65 | 9.5E−08 | 1.64 |
| 277 | 40076_at | nucleotides 1683 to 2285 of SEQ ID NO: 307 | 59.36 | 35.35 | 2.5E−07 | 1.68 |
| 278 | 40177_at | the complement of nucleotides 67 to 276 of SEQ ID NO: 308 | 3.93 | 1.85 | 4.6E−05 | 2.13 |
| 279 | 1891_at | nucleotides 2144 to 2738 of SEQ ID NO: 309 | 9.16 | 4.65 | 1.3E−08 | 1.97 |
| 280 | 31536_at | nucleotides 3430 to 4018 of SEQ ID NO: 310 | 25.56 | 15.75 | 1.2E−08 | 1.62 |
| 281 | 32719_at | nucleotides 1261 to 1780 of SEQ ID NO: 311 | 7.16 | 4.05 | 9.6E−08 | 1.77 |
| 282 | 33371_s_at | nucleotides 420 to 879 of SEQ ID NO: 312 | 21.31 | 11.05 | 8.6E−09 | 1.93 |
| 283 | 35434_at | nucleotides 1591 to 1897 of SEQ ID NO: 313 | 12.62 | 7.25 | 1.7E−08 | 1.74 |
| 284 | 40167_s_at | nucleotides 1405 to 1643 of SEQ ID NO: 314 | 9.11 | 6.45 | 3.3E−06 | 1.41 |
| 285 | 649_s_at | nucleotides 1038 to 1632 of SEQ ID NO: 317 | 172.87 | 266.70 | 3.1E−06 | 0.65 |
| 286 | 31492_at | nucleotides 255 to 758 of SEQ ID NO: 318 | 47.91 | 64.10 | 9.7E−09 | 0.75 |
| 287 | 31955_at | nucleotides 1 to 475 of SEQ ID NO: 319 | 316.33 | 435.15 | 1.4E−08 | 0.73 |
| 288 | 35125_at | SEQ ID NO: 330 | 404.47 | 547.05 | 5.1E−07 | 0.74 |
| 289 | 36463_at | nucleotides 3746 to 4119 of SEQ ID NO: 321 | 13.49 | 20.05 | 1.7E−09 | 0.67 |
| 290 | 36786_at | SEQ ID NO: 329 | 204.07 | 304.40 | 1.1E−09 | 0.67 |
| 291 | 38269_at | nucleotides 1235 to 1699 of SEQ ID NO: 323 | 27.64 | 40.25 | 3.9E−07 | 0.69 |
| 292 | 38527_at | nucleotides 2145 to 2484 of SEQ ID NO: 324 | 53.49 | 70.70 | 6.8E−09 | 0.76 |
| 293 | 40610_at | SEQ ID NO: 331 | 12.56 | 20.50 | 2.7E−06 | 0.61 |
| 294 | 41506_at | nucleotides 1440 to 1952 of SEQ ID NO: 326 | 8.11 | 13.45 | 2.7E−07 | 0.60 |
| 295 | 41604_at | nucleotides 1095 to 1400 of SEQ ID NO: 327 | 13.60 | 21.30 | 3.5E−07 | 0.64 |

TABLE 3

SEQ ID NOs and the Corresponding Entrez Accession Numbers

| SEQ ID NO | Corresponding Entrez Database Accession No. | Reported Source of the Corresponding Entrez Sequence |
| --- | --- | --- |
| 1 | AF051152 | *Homo sapiens* Toll/interleukin-1 receptor-like protein 4 (TIL4) mRNA |
| 2 | AA978353 | |
| 3 | AB006780 | *Homo sapiens* mRNA for galectin-3 |
| 4 | AB013382 | *Homo sapiens* mRNA for DUSP6 |
| 6 | U66359 | Human T54 protein (T54) mRNA |
| 7 | X75593 | *Homo sapiens* mRNA for rab 13 |
| 8 | X91348 | *Homo sapiens* predicted non coding cDNA (DGCR5) |
| 9 | L35240 | Human enigma gene |
| 10 | AF017257 | *Homo sapiens* chromosome 21 derived BAC containing erythroblastosis virus oncogene homolog 2 protein (ets-2) gene |
| 11 | AB011161 | *Homo sapiens* mRNA for KIAA0589 protein |
| 12 | D43642 | Human YL-1 mRNA for YL-1 protein (nuclear protein with DNA-binding ability) |
| 13 | AF055000 | *Homo sapiens* clone 24519 unknown mRNA |
| 14 | AB006537 | *Homo sapiens* mRNA for interleukin 1 receptor accessory protein |
| 15 | X75042 | *Homo sapiens* rel proto-oncogene mRNA |
| 16 | AF032108 | *Homo sapiens* integrin alpha-7 mRNA |
| 17 | L07592 | Human peroxisome proliferator activated receptor mRNA |
| 18 | X52015 | *Homo sapiens* mRNA for interleukin-1 receptor antagonist |
| 19 | AF025533 | *Homo sapiens* leukocyte immunoglobulin-like receptor-3 (LIR-3) mRNA |
| 21 | U05770 | Human annexin V (ANX5) gene, exon 13 |
| 22 | W26700 | |
| 23 | AF052111 | *Homo sapiens* clone 23953 mRNA sequence |
| 24 | M64925 | Human palmitoylated erythrocyte membrane protein (MPP1) mRNA |
| 25 | M19267 | Human tropomyosin mRNA |
| 26 | M62896 | Human lipocortin (LIP) 2 pseudogene mRNA |
| 27 | M13207 | Human granulocyte-macrophage colony-stimulating factor (CSF1) gene |
| 28 | D86961 | Human mRNA for KIAA0206 gene |
| 29 | AA187563 | |
| 30 | J05581 | Human polymorphic epithelial mucin (PEM) mRNA |
| 31 | AF035819 | *Homo sapiens* macrophage receptor MARCO mRNA |
| 32 | X51362 | Human mRNA for dopamine D2 receptor |
| 33 | AA844998 | |
| 34 | AB008775 | *Homo sapiens* AQP9 mRNA for aquaporin 9 |
| 35 | AB000520 | *Homo sapiens* mRNA for APS |
| 36 | X60364 | Human ALAS mRNA for 5-aminolevulinate synthase precursor |
| 37 | X12451 | Human mRNA for pro-cathepsin L (major excreted protein MEP) |
| 38 | AL080235 | *Homo sapiens* mRNA; cDNA DKFZp586E1621 (from clone DKFZp586E1621) |
| 40 | D32143 | Human mRNA for biliverdin-IXbeta reductase I |
| 41 | L22075 | *Homo sapiens* guanine nucleotide regulatory protein (G13) mRNA |
| 42 | D87116 | Human mRNA for MAP kinase kinase 3b |
| 43 | AA135683 | |
| 44 | AF079221 | *Homo sapiens* BCL2/adenovirus E1B 19 kDa-interacting protein 3a mRNA |
| 45 | U48213 | Human D-site binding protein gene, exon 4 |
| 46 | U91316 | Human acyl-CoA thioester hydrolase mRNA |
| 47 | AF059202 | *Homo sapiens* ACAT related gene product 1 mRNA |
| 48 | L76200 | Human guanylate kinase (GUK1) mRNA |
| 49 | L42243 | *Homo sapiens* (clone 51H8) alternatively spliced interferon receptor (IFNAR2) gene, exon 9 |
| 50 | D45421 | Human mRNA for phosphodiesterase I alpha |
| 51 | AL096737 | *Homo sapiens* mRNA; cDNA DKFZp434F152 (from clone DKFZp434F152) |
| 52 | L32831 | *Homo sapiens* G protein-coupled receptor (GPR3) gene |
| 53 | X07834 | Human mRNA for manganese superoxide dismutase (EC 1.15.1.1) |
| 54 | AJ243797 | *Homo sapiens* mRNA for deoxyribonuclease III (drn3 gene) |
| 55 | H12458 | |

TABLE 3-continued

SEQ ID NOs and the Corresponding Entrez Accession Numbers

| SEQ ID NO | Corresponding Entrez Database Accession No. | Reported Source of the Corresponding Entrez Sequence |
|---|---|---|
| 56 | S78798 | 1-phosphatidylinositol-4-phosphate 5-kinase isoform C [human, peripheral blood leukocytes, mRNA, 1835 nt] |
| 57 | M94856 | Human fatty acid binding protein homologue (PA-FABP) mRNA |
| 58 | J05070 | Human type IV collagenase mRNA |
| 59 | J04027 | Human plasma membrane Ca2+ pumping ATPase mRNA |
| 60 | U43843 | Human h-neuro-d4 protein mRNA |
| 61 | D10925 | Human mRNA for HM145 |
| 62 | AJ000480 | *Homo sapiens* mRNA for C8FW phosphoprotein |
| 63 | M25915 | Human complement cytolysis inhibitor (CLI) mRNA |
| 64 | D30783 | *Homo sapiens* mRNA for epiregulin |
| 65 | AF017786 | *Homo sapiens* phosphatidic acid phosphohydrolase homolog (Dri42) mRNA |
| 66 | X79535 | *Homo sapiens* mRNA for beta tubulin, clone nuk_278 |
| 67 | D14689 | Human mRNA for KIAA0023 gene |
| 68 | AL031230 | Human DNA sequence from clone 73M23 on chromosome 6p22.2-22.3; contains the 5' part of the possibly alternatively spliced gene for Phosphatidylinositol-glycan-specific Phospholipase D 1 precursor (EC 3.1.4.50, PIGPLD1, Glycoprotein Phospholipase D, Glycosyl-Phosphatidylinositol specific Phospholipase D), the gene for NAD+-dependent succinic semialdehyde dehydrogenase (SSADH, EC 1.2.1.24), and the 3' part of the KIAA0319 gene; contains ESTs, STSs, GSSs and a putative CpG island, complete sequence |
| 69 | AL049963 | *Homo sapiens* mRNA; cDNA DKFZp564A132 (from clone DKFZp564A132) |
| 70 | Z32684 | *Homo sapiens* mRNA for membrane transport protein (XK gene) |
| 71 | AB020644 | *Homo sapiens* mRNA for KIAA0837 protein |
| 72 | X12496 | Human mRNA for erythrocyte membrane sialoglycoprotein beta (glycophorin C) |
| 73 | L23959 | *Homo sapiens* E2F-related transcription factor (DP-1) mRNA |
| 74 | U61836 | Human putative cyclin G1 interacting protein mRNA |
| 75 | U43774 | Human Fc alpha receptor, splice variant FcalphaR a.2 (CD89) mRNA |
| 76 | M35999 | Human platelet glycoprotein IIIa (GPIIIa) mRNA |
| 77 | L07648 | Human MXI1 mRNA |
| 78 | M24069 | Human DNA-binding protein A (dbpA) gene, 3' end |
| 79 | AF061034 | *Homo sapiens* FIP2 alternatively translated mRNA |
| 80 | U29091 | *Homo sapiens* selenium-binding protein (hSBP) mRNA |
| 81 | U68111 | Human protein phosphatase inhibitor 2 (PPP1R2) gene, exon 6 |
| 82 | X82460 | *Homo sapiens* mRNA for 15-hydroxy prostaglandin dehydrogenase |
| 84 | U58917 | *Homo sapiens* IL-17 receptor mRNA |
| 85 | AB010419 | *Homo sapiens* mRNA for MTG8-related protein MTG16a |
| 86 | AB007943 | *Homo sapiens* mRNA for KIAA0474 protein |
| 87 | Z23115 | *Homo sapiens* bcl-xL mRNA |
| 88 | AF001461 | *Homo sapiens* Kruppel-like zinc finger protein Zf9 mRNA |
| 89 | D14874 | *Homo sapiens* mRNA for adrenomedullin precursor |
| 90 | J05500 | Human beta-spectrin (SPTB) mRNA |
| 91 | M34480 | Human platelet glycoprotein IIb (GPIIb) mRNA |
| 92 | U97067 | *Homo sapiens* alpha-catenin-like protein mRNA |
| 93 | M26683 | Human interferon gamma treatment inducible mRNA |
| 94 | AA527880 | |
| 95 | X72308 | *Homo sapiens* mRNA for monocyte chemotactic protein-3 (MCP-3) |
| 96 | M63835 | Human IgG Fc receptor I gene, exon 6 |
| 97 | U28389 | Human dematin 52 kDa subunit mRNA |
| 98 | U21049 | *Homo sapiens* DD96 mRNA |
| 99 | L40904 | *Homo sapiens* peroxisome proliferator activated receptor gamma (PPARG) mRNA |
| 100 | AI961220 | |

TABLE 3-continued

SEQ ID NOs and the Corresponding Entrez Accession Numbers

| SEQ ID NO | Corresponding Entrez Database Accession No. | Reported Source of the Corresponding Entrez Sequence |
|---|---|---|
| 101 | X74039 | *Homo sapiens* mRNA for urokinase plasminogen activator receptor |
| 102 | L22005 | Human ubiquitin conjugating enzyme mRNA |
| 103 | AI732885 | |
| 104 | U00672 | Human interleukin-10 receptor mRNA |
| 105 | AL050254 | Novel human gene mapping to chomosome 22 |
| 106 | AF026939 | *Homo sapiens* CIG49 (cig49) mRNA |
| 107 | U19599 | Human (BAX delta) mRNA |
| 108 | X64364 | *Homo sapiens* mRNA for M6 antigen |
| 109 | U12471 | Human thrombospondin-1 gene |
| 110 | AF068706 | *Homo sapiens* gamma2-adaptin (G2AD) mRNA |
| 111 | L42542 | Human RLIP76 protein mRNA |
| 112 | AF070587 | *Homo sapiens* clone 24741 mRNA sequence |
| 113 | AJ001481 | *Homo sapiens* mRNA for DUX1 protein |
| 114 | U36341 | Human Xq28 cosmid, creatine transporter (SLC6A8) gene, complete cds, and CDM gene, partial cds |
| 115 | J02973 | Human thrombomodulin gene |
| 116 | AF141349 | *Homo sapiens* beta-tubulin mRNA |
| 117 | AI349593 | |
| 118 | L06895 | *Homo sapiens* antagonizer of myc transcriptional activity (Mad) mRNA |
| 119 | AF065389 | *Homo sapiens* tetraspan NET-4 mRNA |
| 120 | Z35491 | *Homo sapiens* mRNA for novel glucocorticoid receptor-associated protein |
| 121 | AB023211 | *Homo sapiens* mRNA for KIAA0994 protein |
| 122 | M27492 | Human interleukin 1 receptor mRNA |
| 123 | X00737 | Human mRNA for purine nucleoside phosphorylase (PNP; EC 2.4.2.1) |
| 124 | N74607 | |
| 125 | X17644 | Human GST1-Hs mRNA for GTP-binding protein |
| 126 | AI565760 | |
| 128 | X90999 | *Homo sapiens* mRNA for Glyoxalase II |
| 129 | AF059198 | *Homo sapiens* protein kinase/endoribonulcease (IRE1) mRNA |
| 130 | X54412 | Human mRNA for alpha1(IX) collagen (long form) |
| 131 | D38583 | Human mRNA for calgizzarin |
| 132 | D38037 | Human mRNA for FK506-binding protein 12 kDa (hFKBP-12) homologue |
| 134 | J02854 | Human 20-kDa myosin light chain (MLC-2) mRNA |
| 135 | AJ000644 | *Homo sapiens* mRNA for SPOP |
| 136 | AI679353 | |
| 137 | U76248 | Human hSIAH2 mRNA |
| 138 | AA131149 | |
| 139 | AJ011712 | *Homo sapiens* TNNT1 gene, exons 1-11 (and joined CDS) |
| 140 | AB018293 | *Homo sapiens* mRNA for KIAA0750 protein |
| 141 | K00650 | Human fos proto-oncogene (c-fos) |
| 142 | Y00630 | Human mRNA for Arg-Serpin (plasminogen activator-inhibitor 2, PAI-2) |
| 143 | U89606 | Human pyridoxal kinase mRNA |
| 144 | AL049250 | *Homo sapiens* mRNA; cDNA DKFZp564D113 (from clone DKFZp564D113) |
| 145 | M36820 | Human cytokine (GRO-beta) mRNA |
| 146 | U96919 | *Homo sapiens* inositol polyphosphate 4-phosphatase type I-beta mRNA |
| 147 | U70732 | Human glutamate pyruvate transaminase (GPT) gene |
| 149 | S77763 | nuclear factor erythroid 2 isoform f, basic leucine zipper protein {alternatively spliced, exon 1f} [human, fetal liver, mRNA, 1678 nt] |
| 150 | L37127 | *Homo sapiens* RNA polymerase II mRNA |
| 151 | AF055027 | *Homo sapiens* clone 24658 mRNA sequence |
| 152 | AF038171 | *Homo sapiens* clone 23671 mRNA sequence |
| 154 | L17330 | Human pre-T/NK cell associated protein (6H9A) mRNA |
| 155 | M60298 | Human erythrocyte membrane protein band 4.2 (EPB42) mRNA |
| 156 | X90857 | *Homo sapiens* mRNA for-14 gene, containing globin regulatory element |
| 157 | AF089814 | *Homo sapiens* growth suppressor related (DOC-1R) mRNA |
| 158 | AI077476 | |
| 159 | K02401 | Human chorionic somatomammotropin gene hCS-1 |

TABLE 3-continued

SEQ ID NOs and the Corresponding Entrez Accession Numbers

| SEQ ID NO | Corresponding Entrez Database Accession No. | Reported Source of the Corresponding Entrez Sequence |
|---|---|---|
| 160 | AF034209 | *Homo sapiens* RIG-like 5-6 mRNA |
| 161 | M25322 | Human granule membrane protein-140 mRNA |
| 162 | M64788 | Human GTPase activating protein (rap 1 GAP) mRNA |
| 163 | X14787 | Human mRNA for thrombospondin |
| 164 | U62433 | Human nicotinic acetylcholine receptor alpha4 subunit precursor, mRNA |
| 165 | D83664 | Human mRNA for CAAF1 (calcium-binding protein in amniotic fluid 1) |
| 166 | M38690 | Human CD9 antigen mRNA |
| 167 | L19185 | Human natural killer cell enhancing factor (NKEFB) mRNA |
| 168 | W27095 | |
| 169 | X04327 | Human erythrocyte 2,3-bisphosphoglycerate mutase mRNA EC 2.7.5.4 |
| 170 | AF054185 | *Homo sapiens* proteasome subunit HSPC mRNA |
| 171 | M24470 | Human glucose-6-phosphate dehydrogenase |
| 172 | M77016 | Human tropomodulin mRNA |
| 174 | U18548 | Human GPR12 G protein coupled-receptor gene |
| 175 | X97324 | *Homo sapiens* mRNA for adipophilin |
| 176 | L03785 | Human regulatory myosin light chain (MYL5) mRNA |
| 177 | W80399 | |
| 178 | M62397 | colorectal mutant cancer protein mRNA |
| 179 | J02931 | Human placental tissue factor (two forms) mRNA |
| 180 | U65404 | Human erythroid-specific transcription factor EKLF mRNA |
| 182 | M36821 | Human cytokine (GRO-gamma) mRNA |
| 183 | U53204 | Human plectin (PLEC1) mRNA |
| 184 | U81800 | *Homo sapiens* monocarboxylate transporter (MCT3) mRNA |
| 185 | L37033 | Human FK-506 binding protein homologue (FKBP38) mRNA |
| 186 | X55988 | Human EDN mRNA for eosinophil derived neurotoxin |
| 187 | U21551 | Human ECA39 mRNA |
| 188 | J04765 | Human osteopontin mRNA |
| 189 | X54489 | Human gene for melanoma growth stimulatory activity (MGSA) |
| 190 | AL096741 | *Homo sapiens* mRNA; cDNA DKFZp586O0223 (from clone DKFZp586O0223) |
| 192 | U29344 | Human breast carcinoma fatty acid synthase mRNA |
| 193 | U37431 | Human HOXA1 mRNA, long transcript and alternatively spliced forms |
| 194 | Z82244 | Human DNA sequence from clone CTA-286B10 on chromosome 22; contains the 3' end of the TOM1 gene for target of myb1 (chicken) homolog, the HMOX1 gene for Heme Oxygenase (decycling) 1 (HO-1, EC 1.14.99.3), the MCM5 gene for minichromosome maintenance deficient (S. cerevisiae) 5 (cell division cycle 46, DNA Replication Licensing Factor, P1-CDC46), ESTs, STSs, GSSs, and two putative CpG islands |
| 195 | AF002697 | *Homo sapiens* E1B 19K/Bcl-2-binding protein Nip3 mRNA, nuclear gene encoding mitochondrial protein |
| 196 | X95808 | *Homo sapiens* mRNA for protein encoded by a candidate gene, DXS6673E, for mental retardation |
| 197 | M58018 | *Homo sapiens* beta-myosin heavy chain (MYH7) mRNA |
| 198 | M15330 | Human interleukin 1-beta (IL1B) mRNA |
| 199 | L37792 | *Homo sapiens* syntaxin 1A mRNA |
| 200 | AJ006268 | *Homo sapiens* mRNA for putative ATPase |
| 201 | X14362 | Human CR1 mRNA for C3b/C4b receptor secreted form |
| 202 | AL050225 | *Homo sapiens* mRNA; cDNA DKFZp586M1523 (from clone DKFZp586M1523) |
| 203 | M98776 | Human keratin 1 gene |
| 204 | AF070571 | *Homo sapiens* clone 24739 mRNA sequence |
| 205 | M29551 | Human calcineurin A2 mRNA |
| 206 | L42379 | *Homo sapiens* bone-derived growth factor (BPGF-1) mRNA |
| 208 | X16863 | Human Fc-gamma RIII-1 cDNA for Fc-gamma receptor III-1 (CD 16) |
| 209 | U04636 | Human cyclooxygenase-2 (hCox-2) gene |
| 210 | AJ001189 | *Homo sapiens* mRNA for oligophrenin 1 |

TABLE 3-continued

SEQ ID NOs and the Corresponding Entrez Accession Numbers

| SEQ ID NO | Corresponding Entrez Database Accession No. | Reported Source of the Corresponding Entrez Sequence |
|---|---|---|
| 211 | AF039555 | *Homo sapiens* visinin-like protein 1 (VSNL1) mRNA |
| 213 | AB007952 | *Homo sapiens* mRNA for KIAA0483 protein |
| 214 | U51333 | Human hexokinase III (HK3) mRNA |
| 215 | L35848 | *Homo sapiens* IgE receptor beta chain (HTm4) mRNA |
| 216 | U64197 | *Homo sapiens* chemokine exodus-1 mRNA |
| 217 | U94333 | Human C1q/MBL/SPA receptor C1qR(p) mRNA |
| 218 | D10216 | Human mRNA for Pit-1/GHF-1 |
| 219 | X91817 | *Homo sapiens* mRNA for transketolase-like protein (2418 bp) |
| 220 | AF048732 | *Homo sapiens* cyclin T2b mRNA |
| 221 | W27838 | |
| 222 | X02761 | Human mRNA for fibronectin (FN precursor) |
| 223 | J04178 | Human abnormal beta-hexosaminidase alpha chain (HEXA) mRNA, chromosome 15q23-q24 |
| 224 | M21985 | Human steroid receptor TR2 mRNA |
| 225 | W28731 | |
| 226 | X04430 | Human IFN-beta 2a mRNA for interferon-beta-2 |
| 227 | AB002370 | Human mRNA for KIAA0372 gene |
| 228 | U02388 | *Homo sapiens* cytochrome P450 4F2 (CYP4F2) mRNA |
| 229 | M86752 | Human transformation-sensitive protein (IEF SSP 3521) mRNA |
| 230 | D83174 | Human mRNA for collagen binding protein 2 |
| 231 | M14087 | Human HL14 gene encoding beta-galactoside-binding lectin, 3' end, clone 2 |
| 232 | M55067 | Human 47-kD autosomal chronic granulomatous disease protein mRNA |
| 234 | M14752 | Human c-abl gene |
| 235 | AF089750 | *Homo sapiens* flotillin-1 mRNA |
| 236 | AL096744 | *Homo sapiens* mRNA; cDNA DKFZp566H033 (from clone DKFZp566H033) |
| 237 | M55406 | Human intestinal mucin (MUC-3) mRNA |
| 238 | U29175 | Human transcriptional activator (BRG1) mRNA |
| 239 | AF035314 | *Homo sapiens* clone 23651 mRNA sequence |
| 285 | X70940 | *H. sapiens* mRNA for elongation factor 1 alpha-2 |
| 286 | U07802 | Human Tis11d gene |
| 287 | AI803447 | |
| 288 | Z11584 | *Homo sapiens* mRNA for NuMA protein |
| 289 | X15414 | Human mRNA for aldose reductase (EC 1.1.1.2 |
| 290 | AF035262 | *Homo sapiens* BAF57 (BAF57) gene |
| 291 | AI452442 | |
| 292 | AB023208 | *Homo sapiens* mRNA for KIAA0991 protein |
| 293 | M14630 | Human prothymosin alpha mRNA |
| 294 | AB007870 | *Homo sapiens* KIAA0410 mRNA |
| 295 | D67025 | *Homo sapiens* mRNA for proteasome subunit p58 |
| 296 | M69039 | Human pre-mRNA splicing factor SF2p32 |
| 297 | AB017642 | *Homo sapiens* mRNA for oxidative-stress responsive1 |
| 298 | L05424 | Human cell surface glycoprotein CD44 (CD44) gene, exon 14 |
| 299 | U84388 | Human death domain containing protein CRADD mRNA |
| 300 | AF014958 | *Homo sapiens* chemokine receptor X (CKRX) mRNA |
| 301 | AB014607 | *Homo sapiens* mRNA for KIAA0707 protein |
| 302 | AB029036 | *Homo sapiens* mRNA for KIAA1113 protein |
| 303 | AL050119 | *Homo sapiens* mRNA; cDNA DKFZp586C091 |
| 304 | AF052115 | *Homo sapiens* clone 23688 mRNA sequence |
| 305 | AB006909 | *Homo sapiens* mRNA for A-type microphthalmia associated transcription factor |
| 307 | AF004430 | *Homo sapiens* hD54+ins2 isoform (hD54) mRNA |
| 308 | AI732885 | |
| 309 | D14497 | Human mRNA for proto-oncogene protein |
| 310 | AB020693 | *Homo sapiens* mRNA for KIAA0886 protein |
| 311 | L41827 | *Homo sapiens* sensory and motor neuron derived factor (SMDF) mRNA, |
| 312 | U59877 | Human low-Mr GTP-binding protein (RAB31) mRNA |
| 313 | L16794 | Human transcription factor (MEF2) mRNA |
| 314 | AF038187 | *Homo sapiens* clone 23714 mRNA sequence |
| 315 | L29277 | *Homo sapiens* DNA-binding protein (APRF) mRNA |
| 317 | L06797 | Human (clone L5) orphan G protein-coupled receptor mRNA |
| 318 | AB019392 | *Homo sapiens* mRNA of muscle specific gene M9 |

TABLE 3-continued

SEQ ID NOs and the Corresponding Entrez Accession Numbers

| SEQ ID NO | Corresponding Entrez Database Accession No. | Reported Source of the Corresponding Entrez Sequence |
|---|---|---|
| 319 | X65923 | *Homo sapiens* fau mRNA |
| 320 | X67309 | *Homo sapiens* gene for ribosomal protein S6 |
| 321 | AB020680 | *Homo sapiens* mRNA for KIAA0873 protein |
| 322 | AL022721 | Human DNA sequence from clone 109F14 on chromosome 6p21.2-21.3, which contains the alternatively spliced gene for Transcriptional Enhancer Factor TEF-5, the 60S Ribosomal Protein RPL10A gene, a putative ZNF127 LIKE gene, and the PPARD for Peroxisome Proliferator Activated Receptor Delta (PPAR-Delta, PPAR-Beta, Nuclear Hormone Receptor 1, NUC1, NUCI, PPARB). It also contains three putative CpG islands, ESTs, STSs, GSSs and a ca repeat polymorphism. |
| 323 | AL050147 | *Homo sapiens* mRNA; cDNA DKFZp586E0820 (from clone DKFZp586E0820) |
| 324 | U02493 | Human 54 kDa protein mRNA |
| 325 | AI743507 | wf72a06.x2 Soares__NFL__T__GBC__S1 *Homo sapiens* cDNA clone IMAGE: 2361106 3' similar to TR: O88532 O88532 ZINC FINGER RNA BINDING PROTEIN |
| 326 | AF032437 | *Homo sapiens* mitogen activated protein kinase activated protein kinase gene |
| 327 | U79297 | Human clone 23589 mRNA sequence |

Each qualifier in Table 2 represents at least one RCC disease gene which is differentially expressed in the peripheral blood of RCC patients relative to disease-free humans. The RNA transcripts of the RCC disease gene can hybridize to the corresponding qualifier under stringent or nucleic acid array hybridization conditions. As used herein, "hybridize to a qualifier" means to hybridize to at least one oligonucleotide probe listed under the qualifier in ATTACHMENT A. For instance, the RNA transcripts of the RCC disease gene can hybridize under stringent or nucleic acid array hybridization conditions to at least 2, 4, 6, 8, 10, 12, 14 or 16 oligonucleotide probes listed under the corresponding qualifier in ATTACHMENT A. The RNA transcripts of the RCC disease gene can also hybridize under stringent or highly stringent conditions to the CPS of the corresponding qualifier.

RCC disease genes represented by the qualifiers and CPSs of Table 2 can be determined based on the HG-U95Av2 gene chip annotation provided by Affymetrix. They can also be determined based on the Entrez accession numbers listed in Table 3, as appreciated by one of ordinary skill in the art. In addition, the identity of the RCC disease genes can be assessed by BLAST searching the corresponding CPSs or oligonucleotide probes, such as those listed in Table 2 or ATTACHMENT A, against a human genome sequence database. Suitable human genome sequence databases for this purpose include, but are not limited to, the Entrez human genome database maintained at the NCBI. The Entrez human genome database contains about 97.8% of the total human genome sequence, and among them, about 63% are finished sequence and about 34.8% are unfinished sequence. The NCBI provides publicly accessible BLAST programs, such as "blastn," for BLAST searching its sequence database.

Each CPS aligns with the protein-coding strand(s) of the corresponding RCC disease gene(s). Preferably, each CPS aligns to the corresponding RCC disease gene(s) with at least 97% sequence identity. Each CPS can hybridize to the corresponding RCC disease gene(s) under stringent or highly stringent conditions. Table 4 lists the CPSs and their corresponding RCC disease genes. All of the genes listed in Table 4 are collectively referred to as "Gene-Table 4."

TABLE 4

RCC Disease Genes

| CPS No. | Corresponding Gene | Sequences Useful for Making Probe/Primers for Detecting the Corresponding Gene |
|---|---|---|
| 1 | TLR2 | AF051152 (SEQ ID NO: 1); and SEQ ID NO: 240 |
| 2 | SLC1A4 | the complement of AA978353 (SEQ ID NO: 2) |
| 3 | LGALS3 | AB006780 (SEQ ID NO: 3) |
| 4 | DUSP6 | AB013382 (SEQ ID NO: 4); and SEQ ID NO: 241 |
| 5 | KHSRP | SEQ ID NO: 5; and the complement of AA628946 (SEQ ID NO: 242) |
| 6 | T54 | U66359 (SEQ ID NO: 6) |
| 7 | RAB13 | X75593 (SEQ ID NO: 7) |
| 8 | DGCR5 | X91348 (SEQ ID NO: 8) |
| 9 | ENIGMA | L35240 (SEQ ID NO: 9) |
| 10 | ETS2 | AF017257 (SEQ ID NO: 10); and J04102 (SEQ ID NO: 243) |

TABLE 4-continued

RCC Disease Genes

| CPS No. | Corresponding Gene | Sequences Useful for Making Probe/Primers for Detecting the Corresponding Gene |
|---|---|---|
| 11 | PIP5K1C | AB011161 (SEQ ID NO: 11) |
| 12 | TCFL1 | D43642 (SEQ ID NO: 12); and SEQ ID NO: 244 |
| 13 | UNK_AF055000 | AF055000 (SEQ ID NO: 13) |
| 14 | IL1RAP | AB006537 (SEQ ID NO: 14) |
| 15 | REL | X75042 (SEQ ID NO: 15) |
| 16 | ITGA7 | AF032108 (SEQ ID NO: 16) |
| 17 | PPARD | L07592 (SEQ ID NO: 17) |
| 18 | IL1RN | X52015 (SEQ ID NO: 18) |
| 19 | LILRB3 | AF025533 (SEQ ID NO: 19) |
| 20 | FOXO3A | SEQ ID NO: 20; and AF032886 (SEQ ID NO: 245) |
| 21 | ANXA5 | U05770 (SEQ ID NO: 21) |
| 22 | SLC17A7 (UNK_W26700) | W26700 (SEQ ID NO: 22) |
| 23 | LOC51172 (UNK_AF052111 or APAA) | AF052111 (SEQ ID NO: 23) |
| 24 | MPP1 | M64925 (SEQ ID NO: 24) |
| 25 | TPM1 | M19267 (SEQ ID NO: 25) |
| 26 | UNK_M62896 | M62896 (SEQ ID NO: 26) |
| 27 | CSF2 | M13207 (SEQ ID NO: 27) |
| 28 | LHFPL2 | D86961 (SEQ ID NO: 28) (3676-4193) |
| 29 | PARVB (UNK_AA187563) | the complement of AA187563 (SEQ ID NO: 29) |
| 30 | MUC1 | J05581 (SEQ ID NO: 30) |
| 31 | MARCO | AF035819 (SEQ ID NO: 31) |
| 32 | DRD2 | X51362 (SEQ ID NO: 32) |
| 33 | PPY | the complement of AA844998 (SEQ ID NO: 33) |
| 34 | AQP9 | AB008775 (SEQ ID NO: 34) |
| 35 | APS | AB000520 (SEQ ID NO: 35) |
| 36 | ALAS2 | X60364 (SEQ ID NO: 36) |
| 37 | CTSL | X12451 (SEQ ID NO: 37) |
| 38 | DKFZP586E1621 | AL080235 (SEQ ID NO: 38) |
| 39 | PRO2389 (UNK_W28931) | SEQ ID NO: 39; and the complement of W28931 (SEQ ID NO: 246) |
| 40 | BLVRB | D32143 (SEQ ID NO: 40) |
| 41 | GNA13 | L22075 (SEQ ID NO: 41) |
| 42 | MAP2K3 | D87116 (SEQ ID NO: 42) |
| 43 | BASP1 | AA135683 (SEQ ID NO: 43) |
| 44 | BNIP3L | AF079221 (SEQ ID NO: 44) |
| 45 | DBP | U48213 (SEQ ID NO: 45) |
| 46 | HBACH | U91316 (SEQ ID NO: 46); and SEQ ID NO: 247 |
| 47 | DGAT | AF059202 (SEQ ID NO: 47) |
| 48 | GUK1 | L76200 (SEQ ID NO: 48) |
| 49 | IL10RB | L42243 (SEQ ID NO: 49) |
| 50 | PDNP2 | D45421 (SEQ ID NO: 50) |
| 51 | SLC5A6 (UNK_AL096737) | AL096737 (SEQ ID NO: 51) |
| 52 | GPR3 | L32831 (SEQ ID NO: 52) |
| 53 | SOD2 | X07834 (SEQ ID NO: 53); and SEQ ID NO: 248 |
| 54 | TREX1 | AJ243797 (SEQ ID NO: 54) |
| 55 | WNT6 (UNK_H12458) | H12458 (SEQ ID NO: 55) |
| 56 | PIP5K2A (UNK_S78798) | S78798 (SEQ ID NO: 56) |
| 57 | FABP5 | M94856 (SEQ ID NO: 57); and SEQ ID NO: 249 |
| 58 | MMP9 | J05070 (SEQ ID NO: 58) |
| 59 | ATP2B1 | J04027 (SEQ ID NO: 59); and SEQ ID NO: 250 |
| 60 | NEUD4 | U43843 (SEQ ID NO: 60) |
| 61 | CCR1 | D10925 (SEQ ID NO: 61); and SEQ ID NO: 251 |
| 62 | C8FW | AJ000480 (SEQ ID NO: 62); and SEQ ID NO: 252 |
| 63 | CLU | M25915 (SEQ ID NO: 63); and SEQ ID NO: 253 |
| 64 | EREG | D30783 (SEQ ID NO: 64) |
| 65 | PPAP2B | AF017786 (SEQ ID NO: 65) SEQ ID NO: 254 |

TABLE 4-continued

RCC Disease Genes

| CPS No. | Corresponding Gene | Sequences Useful for Making Probe/Primers for Detecting the Corresponding Gene |
|---|---|---|
| 66 | TUBB | X79535 (SEQ ID NO: 66) |
| 67 | NUP214 | D14689 (SEQ ID NO: 67) |
| 68 | ALDH5A1 | AL031230 (SEQ ID NO: 68) |
| 69 | LOC64116 (also referred to as UNK_AL049963) | AL049963 (SEQ ID NO: 69) |
| 70 | XK | Z32684 (SEQ ID NO: 70) |
| 71 | KIAA0837 | AB020644 (SEQ ID NO: 71) |
| 72 | GYPC | X12496 (SEQ ID NO: 72) |
| 73 | TFDP1 | L23959 (SEQ ID NO: 73); and W28479 (SEQ ID NO: 255) |
| 74 | C20orf16 (UNK_U61836) | U61836 (SEQ ID NO: 74) |
| 75 | FCAR | U43774 (SEQ ID NO: 75) |
| 76 | ITGB3 | M35999 (SEQ ID NO: 76) |
| 77 | MXI1 | L07648 (SEQ ID NO: 77); and D63940 (SEQ ID NO: 256) |
| 78 | CSDA | M24069 (SEQ ID NO: 78); and SEQ ID NO: 257 |
| 79 | FIP2 | AF061034 (SEQ ID NO: 79) |
| 80 | SELENBP1 | U29091 (SEQ ID NO: 80); and SEQ ID NO: 258 |
| 81 | PPP1R2 | U68111 (SEQ ID NO: 81) |
| 82 | HPGD | X82460 (SEQ ID NO: 82) |
| 83 | SLC4A1 | SEQ ID NO: 83; and M27819 (SEQ ID NO: 259) |
| 84 | IL17R | U58917 (SEQ ID NO: 84) |
| 87 | CBFA2T3 | AB010419 (SEQ ID NO: 85) |
| 89 | RAP1GA1 (KIAA0474) | AB007943 (SEQ ID NO: 86) |
| 90 | BCL2L1 | Z23115 (SEQ ID NO: 87); and SEQ ID NO: 260 |
| 91 | COPEB | AF001461 (SEQ ID NO: 88) |
| 92 | ADM | D14874 (SEQ ID NO: 89); and SEQ ID NO: 261 |
| 93 | SPTB | J05500 (SEQ ID NO: 90) |
| 94 | ITGA2B | M34480 (SEQ ID NO: 91) |
| 95 | CTNNAL1 (UNK_U97067) | U97067 (SEQ ID NO: 92) |
| 96 | SCYA2 | M26683 (SEQ ID NO: 93); and M28225 (SEQ ID NO: 262) |
| 97 | NDUFB7 | the complement of AA527880 (SEQ ID NO: 94) |
| 98 | SCYA7 | X72308 (SEQ ID NO: 95) |
| 99 | FCGR1A | M63835 (SEQ ID NO: 96); and SEQ ID NO: 263 |
| 100 | EPB49 | U28389 (SEQ ID NO: 97) |
| 101 | DD96 | U21049 (SEQ ID NO: 98) |
| 102 | PPARG | L40904 (SEQ ID NO: 99) |
| 103 | SPINK1 | the complement of AI961220 (SEQ ID NO: 100) |
| 104 | PLAUR | X74039 (SEQ ID NO: 101) |
| 105 | CDC34 | L22005 (SEQ ID NO: 102) |
| 106 | UNK_AI732885 | the complement of AI732885 (SEQ ID NO: 103) |
| 107 | IL10RA | U00672 (SEQ ID NO: 104) |
| 108 | FBX7 | AL050254 (SEQ ID NO: 105) |
| 109 | IFIT4 | AF026939 (SEQ ID NO: 106) |
| 110 | BAX | U19599 (SEQ ID NO: 107) |
| 111 | BSG | X64364 (SEQ ID NO: 108) |
| 112 | THBS1 (UNK_U12471) | U12471 (SEQ ID NO: 109) |
| 113 | G2AD | AF068706 (SEQ ID NO: 110) |
| 115 | RALBP1 | L42542 (SEQ ID NO: 111) |
| 116 | UNK_AF070587 (LOC196932) | AF070587 (SEQ ID NO: 112) |
| 117 | DUX1 | AJ001481 (SEQ ID NO: 113) |
| 118 | SLC6A8 | U36341 (SEQ ID NO: 114) |
| 119 | THBD | J02973 (SEQ ID NO: 115) |
| 120 | UNK_AF141349 (Tubulin, Beta) | AF141349 (SEQ ID NO: 116) |
| 123 | HBE1 | the complement of AI349593 (SEQ ID NO: 117); and SEQ ID NO: 264 |
| 125 | MAD | L06895 (SEQ ID NO: 118) |

TABLE 4-continued

RCC Disease Genes

| CPS No. | Corresponding Gene | Sequences Useful for Making Probe/Primers for Detecting the Corresponding Gene |
|---|---|---|
| 126 | TSPAN-5 | AF065389 (SEQ ID NO: 119) |
| 127 | BAG1 | Z35491 (SEQ ID NO: 120) |
| 128 | PDI2 | AB023211 (SEQ ID NO: 121) |
| 129 | IL1R1 | M27492 (SEQ ID NO: 122) |
| 130 | NP | X00737 (SEQ ID NO: 123) |
| 131 | AQP3 (UNK_N74607) | the complement of N74607 (SEQ ID NO: 124) |
| 132 | GSPT1 | X17644 (SEQ ID NO: 125) |
| 133 | GEF-2 | the complement of AI565760 (SEQ ID NO: 126) |
| 134 | HBD | SEQ ID NO: 127; and V00505 (SEQ ID NO: 265) |
| 135 | HAGH | X90999 (SEQ ID NO: 128) |
| 136 | ERN1 | AF059198 (SEQ ID NO: 129) |
| 137 | COL9A1 | X54412 (SEQ ID NO: 130) |
| 138 | S100A11 | D38583 (SEQ ID NO: 131) |
| 139 | FKBP1B | D38037 (SEQ ID NO: 132) |
| 141 | RNAH | SEQ ID NO: 133 AJ223948 (SEQ ID NO: 266) |
| 142 | MYRL2 | J02854 (SEQ ID NO: 134) |
| 143 | SPOP | AJ000644 (SEQ ID NO: 135) |
| 144 | SLC11A1 (UNK_AI679353) | the complement of AI679353 (SEQ ID NO: 136) |
| 145 | SIAH2 | U76248 (SEQ ID NO: 137); and SEQ ID NO: 267 |
| 146 | S100P | AA131149 (SEQ ID NO: 138) |
| 147 | TNNT1 | AJ011712 (SEQ ID NO: 139); SEQ ID NO: 268; and M19309 (SEQ ID NO: 269) |
| 148 | KIAA0750 | AB018293 (SEQ ID NO: 140) |
| 149 | FOS | K00650 (SEQ ID NO: 141) |
| 150 | PAI2 | Y00630 (SEQ ID NO: 142) |
| 151 | PDXK | U89606 (SEQ ID NO: 143) |
| 152 | UNK_AL049250 | AL049250 (SEQ ID NO: 144) |
| 153 | GRO2 | M36820 (SEQ ID NO: 145) |
| 154 | INPP4A | U96919 (SEQ ID NO: 146) |
| 155 | GPT | U70732 (SEQ ID NO: 147) |
| 156 | MYL4 | SEQ ID NO: 148; and X58851 (SEQ ID NO: 270) |
| 157 | NFE2 | S77763 (SEQ ID NO: 149) |
| 158 | POLR2J | L37127 (SEQ ID NO: 150) |
| 159 | CARM1 | AF055027 (SEQ ID NO: 151) |
| 160 | UNK_AF038171 | AF038171 (SEQ ID NO: 152) |
| 161 | RAB2 | SEQ ID NO: 153; and AF070629 (SEQ ID NO: 271) |
| 162 | 6H9A | L17330 (SEQ ID NO: 154) |
| 163 | EPB42 | M60298 (SEQ ID NO: 155); and SEQ ID NO: 272 |
| 164 | CGTHBA | X90857 (SEQ ID NO: 156) |
| 165 | DOC-1R | AF089814 (SEQ ID NO: 157) |
| 166 | KIAA0353 | the complement of AI077476 (SEQ ID NO: 158) |
| 167 | CSH1 | SEQ ID NO: 159 |
| 168 | LOC51048 | AF034209 (SEQ ID NO: 160) |
| 169 | SELP | M25322 (SEQ ID NO: 161) |
| 170 | RAP1GA1 | M64788 (SEQ ID NO: 162) |
| 171 | THBS1 | X14787 (SEQ ID NO: 163) |
| 172 | CHRNA4 | U62433 (SEQ ID NO: 164) |
| 173 | S100A12 | D83664 (SEQ ID NO: 165) |
| 174 | CD9 | M38690 (SEQ ID NO: 166) |
| 175 | TDPX1 | L19185 (SEQ ID NO: 167) |
| 176 | B7 | W27095 (SEQ ID NO: 168) |
| 177 | BPGM | X04327 (SEQ ID NO: 169) |
| 178 | PSMA7 | AF054185 (SEQ ID NO: 170); and SEQ ID NO: 273 |
| 179 | GMPR | M24470 (SEQ ID NO: 171); and SEQ ID NO: 274 |
| 180 | TMOD | M77016 (SEQ ID NO: 172) |
| 181 | C4A | SEQ ID NO: 173; and U24578 (SEQ ID NO: 275), such nucleotides 16881 to 16928 and nucleotides 17131-17239 of SEQ ID NO: 275 |
| 182 | GPR12 | U18548 (SEQ ID NO: 174) |

TABLE 4-continued

RCC Disease Genes

| CPS No. | Corresponding Gene | Sequences Useful for Making Probe/Primers for Detecting the Corresponding Gene |
|---|---|---|
| 183 | ADFP | X97324 (SEQ ID NO: 175); and SEQ ID NO: 276 |
| 184 | MYL5 | L03785 (SEQ ID NO: 176) |
| 185 | DPM2 | the complement of W80399 (SEQ ID NO: 177) |
| 186 | MCC | M62397 (SEQ ID NO: 178) |
| 187 | F3 | J02931 (SEQ ID NO: 179) |
| 188 | KLF1 | U65404 (SEQ ID NO: 180) |
| 189 | HBG2 | SEQ ID NO: 181; and M91036 (SEQ ID NO: 277), such as nucleotides 2162-2268, 2391-2614 or 3501-3565 of SEQ ID NO: 277 |
| 190 | GRO3 | M36821 (SEQ ID NO: 182) |
| 191 | PLEC1 | U53204 (SEQ ID NO: 183) |
| 192 | SLC16A3 | U81800 (SEQ ID NO: 184) |
| 194 | FKBP8 | L37033 (SEQ ID NO: 185) |
| 195 | RNASE2 | X55988 (SEQ ID NO: 186) |
| 196 | BCAT1 | U21551 (SEQ ID NO: 187); and SEQ ID NO: 278 |
| 199 | SPP1 | J04765 (SEQ ID NO: 188); and AF052124 (SEQ ID NO: 279) |
| 201 | GRO1 | X54489 (SEQ ID NO: 189) |
| 202 | DKFZP586O0223 | AL096741 (SEQ ID NO: 190) |
| 205 | FASN | U29344 (SEQ ID NO: 192) |
| 206 | HOXA1 | U37431 (SEQ ID NO: 193) |
| 207 | HMOX1 | Z82244 (SEQ ID NO: 194) |
| 208 | BNIP3 | AF002697 (SEQ ID NO: 195) |
| 209 | ZNF261 | X95808 (SEQ ID NO: 196) |
| 210 | MYH7 | M58018 (SEQ ID NO: 197) |
| 211 | IL1B | M15330 (SEQ ID NO: 198); and SEQ ID NO: 191 |
| 212 | STX1A | L37792 (SEQ ID NO: 199) |
| 213 | ATPASEP | AJ006268 (SEQ ID NO: 200); and SEQ ID NO: 280 |
| 214 | CR1 | X14362 (SEQ ID NO: 201) |
| 215 | DKFZP586M1523 | AL050225 (SEQ ID NO: 202) |
| 216 | KRT1 | M98776 (SEQ ID NO: 203) |
| 217 | UNK_AF070571 (EXT1) | AF070571 (SEQ ID NO: 204) |
| 218 | PPP3CB | M29551 (SEQ ID NO: 205) |
| 219 | QSCN6 | L42379 (SEQ ID NO: 206) |
| 220 | PRF1 | SEQ ID NO: 207 M28393 (SEQ ID NO: 281) |
| 221 | FCGR3B | X16863 (SEQ ID NO: 208) |
| 222 | PTGS2 | U04636 (SEQ ID NO: 209) |
| 223 | OPHN1 | AJ001189 (SEQ ID NO: 210) |
| 224 | VSNL1 | AF039555 (SEQ ID NO: 211) |
| 225 | FECH | SEQ ID NO: 212; and D00726 (SEQ ID NO: 282) |
| 226 | KIAA0483 | AB007952 (SEQ ID NO: 213) |
| 227 | HK3 | U51333 (SEQ ID NO: 214) |
| 228 | MS4A3 | L35848 (SEQ ID NO: 215) |
| 229 | SCYA20 | U64197 (SEQ ID NO: 216) |
| 230 | C1QR1 | U94333 (SEQ ID NO: 217) |
| 231 | POU1F1 | D10216 (SEQ ID NO: 218); and D12892 (SEQ ID NO: 283) |
| 232 | TKTL1 | X91817 (SEQ ID NO: 219) |
| 234 | CCNT2 | AF048732 (SEQ ID NO: 220) |
| 235 | ATP6V1H (UNK_W27838) | W27838 (SEQ ID NO: 221) |
| 236 | FN1 | X02761 (SEQ ID NO: 222) |
| 237 | UNK_J04178 (HEXA) | J04178 (SEQ ID NO: 223) |
| 239 | NR2C1 | M21985 (SEQ ID NO: 224) |
| 240 | KIAA0168 | W28731 (SEQ ID NO: 225) |
| 241 | IL6 | X04430 (SEQ ID NO: 226) |
| 242 | KIAA0372 | AB002370 (SEQ ID NO: 227) |
| 243 | CYP4F2 | U02388 (SEQ ID NO: 228) |
| 244 | ST1P1 | M86752 (SEQ ID NO: 229) |
| 245 | CBP2 | D83174 (SEQ ID NO: 230) |
| 246 | UNK_M14087 | M14087 (SEQ ID NO: 231) |
| 247 | NCF1 | M55067 (SEQ ID NO: 232) |
| 248 | CHN2 | SEQ ID NO: 233; and U07223 (SEQ ID NO: 284) |
| 249 | ABL1 | M14752 (SEQ ID NO: 234) |

TABLE 4-continued

RCC Disease Genes

| CPS No. | Corresponding Gene | Sequences Useful for Making Probe/Primers for Detecting the Corresponding Gene |
|---|---|---|
| 250 | FLOT1 | AF089750 (SEQ ID NO: 235) |
| 251 | REV3L (UNK_AL096744) | AL096744 (SEQ ID NO: 236) |
| 252 | MUC3 | M55406 (SEQ ID NO: 237) |
| 253 | SMARCA4 | U29175 (SEQ ID NO: 238) |
| 254 | LOC92684 (UNK_AF035314) | AF035314 (SEQ ID NO: 239) |
| 255 | EEF1A2 | X70940 (SEQ ID NO: 285) |
| 256 | BRF2 | U07802 (SEQ ID NO: 286) |
| 257 | SNRPG | the complement of AI803447 (SEQ ID NO: 287) |
| 258 | NUMA1 | Z11584 (SEQ ID NO: 288) |
| 259 | AKR1B1 | X15414 (SEQ ID NO: 289) |
| 260 | SMARCE1 | AF035262 (SEQ ID NO: 290); and SEQ ID NO: 328 |
| 261 | KIAA0669 | the complement of AI452442 (SEQ ID NO: 291) |
| 262 | MSF | AB023208 (SEQ ID NO: 292) |
| 263 | PTMA | M14630 (SEQ ID NO: 293) |
| 264 | KIAA0410 | AB007870 (SEQ ID NO: 294) |
| 265 | PSMD3 | D67025 (SEQ ID NO: 295) |
| 266 | C1QBP | M69039 (SEQ ID NO: 296) |
| 267 | OSR1 | AB017642 (SEQ ID NO: 297) |
| 268 | CD44 | L05424 (SEQ ID NO: 298) |
| 269 | CRADD | U84388 (SEQ ID NO: 299) |
| 270 | CCRL2 | AF014958 (SEQ ID NO: 300) |
| 271 | KIAA0707 | AB014607 (SEQ ID NO: 301) |
| 272 | KIAA1113 | AB029036 (SEQ ID NO: 302); and SEQ ID NO: 316 |
| 273 | UNK_AL050119 | AL050119 (SEQ ID NO: 303) |
| 274 | UNK_AF052115 | AF052115 (SEQ ID NO: 304) |
| 275 | MITF | AB006909 (SEQ ID NO: 305) |
| 276 | STAT3 | SEQ ID NO: 306; and L29277 (SEQ ID NO: 315) |
| 277 | TPD52L2 | AF004430 (SEQ ID NO: 307) |
| 278 | UNK_AI732885 | the complement of AI732885 (SEQ ID NO: 308) |
| 279 | MAP3K8 | D14497 (SEQ ID NO: 309) |
| 280 | NSP-CL | AB020693 (SEQ ID NO: 310) |
| 281 | NRG1 | L41827 (SEQ ID NO: 311) |
| 282 | RAB31 | U59877 (SEQ ID NO: 312) |
| 283 | MEF2D | L16794 (SEQ ID NO: 313) |
| 284 | UNK_AF038187 | AF038187 (SEQ ID NO: 314) |
| 285 | CXCR4 | L06797 (SEQ ID NO: 317) |
| 286 | M9 | AB019392 (SEQ ID NO: 318) |
| 287 | FAU | X65923 (SEQ ID NO: 319) |
| 288 | RPS6 | X67309 (SEQ ID NO: 320); and SEQ ID NO: 330 |
| 289 | BAG5 | AB020680 (SEQ ID NO: 321) |
| 290 | UNK_AL022721 | the complement of SEQ ID NO: 322 (AL022721); and SEQ ID NO: 329 |
| 291 | DKZP586E0820 | AL050147 (SEQ ID NO: 323) |
| 292 | NONO | U02493 (SEQ ID NO: 324) |
| 293 | UNK_AI743507 | the complement of SEQ ID NO: 325 (AI743507); and SEQ ID NO: 331 |
| 294 | MAPKAPK5 | AF032437 (SEQ ID NO: 326) |
| 295 | UNK_U79297 | U79297 (SEQ ID NO: 327) |

CPS 1 corresponds to TLR2 which encodes toll-like receptor 2. TLR2 has LocusID: 7097, and is located on chromosome 4 with reported cytogenetic location 4q32. The protein encoded by TLR2 gene is a member of the Toll-like receptor (TLR) family which is believed to play a fundamental role in pathogen recognition and activation of innate immunity. TLRs are highly conserved from Drosophila to humans and share structural and functional similarities. They recognize pathogen-associated molecular patterns (PAMPs) that are expressed on infectious agents, and mediate the production of cytokines necessary for the development of effective immunity. The various TLRs exhibit different patterns of expression. TLR2 is reported to be expressed abundantly in peripheral blood leukocytes, and to mediate host response to Gram-positive bacteria and yeast via stimulation of NF-kappaB. TLR2 may also mediate the signal for apoptosis.

CPS 2 corresponds to SLC1A4 which encodes solute carrier family 1 (glutamate/neutral amino acid transporter), member 4. SLC1A4 has LocusID: 6509, and is localized on chromosome 2 with reported cytogenetic location 2p15-p13. The gene product is a sodium-dependent neutral amino acid transporter, and has independent chloride channel activity. It may function to equilibrate pools of neutral amino acids.

CPS 3 corresponds to LGALS3 which encodes lectin, galactoside-binding, soluble, 3 (galectin 3). LGALS3 has LocusID: 3958, and is localized on chromosome 14 with reported cytogenetic location 14q21-q22. LGALS3 may be involved in cell growth regulation.

CPS 4 corresponds to DUSP6 which encodes dual specificity phosphatase 6. DUSP6 has LocusID: 1848, and is localized on chromosome 12 with reported cytogenetic location 12q22-q23.

The protein encoded by DUSP6 gene is a member of the dual specificity protein phosphatase subfamily. These phosphatases may inactivate their target kinases by dephosphorylating both the phosphoserine/threonine and phosphotyrosine residues. They may negatively regulate members of the mitogen-activated protein (MAP) kinase superfamily (MAPK/ERK, SAPK/JNK, p38), which are associated with cellular proliferation and differentiation. Different members of the family of dual specificity phosphatases show distinct substrate specificities for various MAP kinases, different tissue distribution and subcellular localization, and different modes of inducibility of their expression by extracellular stimuli. It is reported that DUSP6 gene product inactivates ERK2, is expressed in a variety of tissues with high levels of expression in heart and pancreas, and is localized in the cytoplasm. Dual specificity protein phosphatase 6 may selectively dephosphorylate and inactivate MAP kinase.

CPS 5 corresponds to KHSRP which encodes KH-type splicing regulatory protein (FUSE binding protein 2). KHSRP has LocusID: 8570, and is localized on chromosome 19 with reported cytogenetic location 19p13.3. It is reported that KHSRP gene product is a component of a multiprotein complex and may be involved in the splicing of the N1 exon of SRC. The genomic sequence (nucleotides 544983 to 544793 of chromosome 19) that aligns to CPS 5 is located 3' to the polypeptide-coding sequence of KHSRP. This genomic sequence is also located 3' to the polypeptide-coding sequence of LOC125980. LOC125980 encodes a protein similar to complement C3 precursor (human). It has reported cytogenetic location 19p13.3.

Nucleotides 1-501 of SEQ ID NO: 241 (AA628946) have about 99% sequence identity to KHSRP. Consequently, SEQ ID NO: 241 can be used to design probes for detecting the expression profile of KHSRP. Nucleotides 1-286 of SEQ ID NO: 241 also show about 89-93% sequence identity to a genomic sequence near the polypeptide-coding sequence of putative gene LOC138679. LOC138679 encodes a protein similar to KH-type splicing regulatory protein (FUSE binding protein 2) and KH-type splicing regulatory protein (FUSE-binding protein 2). LOC138679 is located on chromosome 9 with reported cytogenetic location 9p21.1.

CPS 6 corresponds to T54 which encodes T54 protein. T54 has LocusID: 27238, and is localized on chromosome X with reported cytogenetic location Xp11.23. T54 protein has a region of low similarity to S. cerevisiae Spp2p.

CPS 7 corresponds to RAB13, member RAS oncogene family. RAB13 has LocusID: 5872, and is localized on chromosome 1 with reported cytogenetic location 1q21.2. RAB13 gene product is known as GTP-binding protein 13, and may be involved in vesicle transport. It is a member of the RAB family of small GTPases. Nucleotides 106-1212 of SEQ ID NO: 7 (X75593) also align to a genomic sequence localized on chromosome 12 with reported cytogenetic location 12q13.

CPS 8 corresponds to a genomic sequence (DGCR5) at DiGeorge syndrome critical region 5 on chromosome 22. The corresponding genomic sequence is located 3' to the coding sequence of putative gene LOC128966 (similar to carbonic anhydrase 15). LOC128966 has LocusID: 9993, and is localized at cytogenetic location 22q11.1.

CPS 8 also shows about 97% sequence identity to a genomic sequence near the putative gene LOC91208 on chromosome 22. LOC91208 has reported cytogenetic location 22q11.21.

Blast search of X91348 (SEQ ID NO: 8) shows a corresponding genomic sequence which is localized on chromosome 22. The genomic sequence includes putative gene LOC200301 (similar to KIAA1647 protein) and DiGeorge syndrome gene A (DGS-A). DGS-A has LocusID: 25787. Deletions of the region near 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22.

In addition, fragments of nucleotides 132 to 699 of X91348 have 91% sequence identity to CELSR1 which encodes cadherin, EGF LAG seven-pass G-type receptor 1 (flamingo homolog, Drosophila). CELSR1 has LocusID: 9620, and is also localized on chromosome 22.

CPS 9 corresponds to ENIGMA which encodes enigma (LIM domain protein). ENIGMA has LocusID: 9260, and is localized on chromosome 5 with reported cytogenetic location 5q35.3. The protein encoded by this gene is representative of a family of proteins composed of conserved PDZ and LIM domains. LIM domains are proposed to function in protein-protein recognition in a variety of contexts including gene transcription and development and in cytoskeletal interaction. The LIM domains of ENIGMA gene product may bind to protein kinases, whereas the PDZ domain may bind to actin filaments. The gene product may be involved in the assembly of an actin filament-associated complex essential for transmission of ret/ptc2 mitogenic signaling. The biological function of ENIGMA gene product is proposed to be that of an adapter, with the PDZ domain localizing the LIM-binding proteins to actin filaments of both skeletal muscle and nonmuscle tissues. It is also reported that ENIGMA gene product can bind to the insulin receptor (INSR).

CPS 9 also has about 99% sequence identity to LOC220783 which encodes a protein similar to enigma (LIM domain protein). LOC220783 is localized on chromosome 5 with reported cytogenetic location 5q35.3.

CPS 10 corresponds to ETS2 which encodes v-ets erythroblastosis virus E26 oncogene homolog 2 (avian). ETS2 has LocusID: 2114, and is localized on chromosome 21 with reported cytogenetic location 21q22.2. ETS2 gene product is believed to be a transcription factor, and may have a role in some skeletal abnormalities in Downs syndrome.

CPS 11 corresponds to PIP5K1C which encodes phosphatidylinositol-4-phosphate 5-kinase, type I, gamma. PIP5K1C has LocusID: 23396, and is localized on chromosome 19 with reported cytogenetic location 19p13.3.

CPS 12 corresponds to TCFL1 which encodes transcription factor-like 1. The gene has LocusID: 6944, and is localized on chromosome 1 with reported cytogenetic location 1q21. The coding sequence of putative gene LOC148320 is located within TCFL1. LOC148320 also aligns with CPS 12.

CPS 13 can be derived from Homo sapiens mRNA for unknown liver orphan. The hypothetical gene(s) which corresponds to CPS 13 and produces the RNA transcripts capable of hybridizing under stringent conditions to CPS 13 is herein referred to as UNK-AF055000.

CPS 14 corresponds to IL1RAP which encodes interleukin 1 receptor accessory protein. The gene has LocusID: 3556, and is localized on chromosome 3 with reported cytogenetic location 3q28. The gene product is a co-receptor for IL-1RI (IL1R1).

CPS 15 corresponds to REL which encodes v-rel reticuloendotheliosis viral oncogene homolog (avian). The gene has LocusID: 5966, and is localized on chromosome 2 at reported cytogenetic location 2p13-p12. The gene product is considered to be a transcription factor.

CPS 16 corresponds to ITGA7 which encodes integrin, alpha 7. The gene has LocusID: 3679, and is localized on chromosome 12 with reported cytogenetic location 12q13.

ITGA7 encodes integrin alpha chain 7. Integrins are heterodimeric integral membrane proteins composed of an alpha chain and a beta chain. Alpha chain 7 undergoes post-translational cleavage within the extracellular domain to yield disulfide-linked light and heavy chains that join with beta 1 to form an integrin that binds to the extracellular matrix protein laminin-1. Alpha 7 beta 1 is a major integrin complex expressed in differentiated muscle cells. Splice variants of alpha 7 that differ in both the extracellular and cytoplasmic domains exist in the mouse. However, to date only a single human transcript type has been isolated. It contains extracellular and cytoplasmic domains corresponding to the mouse X2 and B variants, respectively. A unique extracellular splice variant has been identified in human, although it may represent a minor species and its biological significance is unclear. Alpha 7 subunit of integrin is a lamninin receptor.

Affymetrix annotation suggests that CPS 17 corresponds to PPARD. Blast search against the Entrez human genome database shows that CPS 17 also aligns to LOC221486 with over 98% sequence identity. LOC221486 encodes a protein similar to peroxisome proliferator activated receptor beta (PPAR-beta) (PPAR-delta) (Nuclear hormone receptor 1) (NUC1) (NUCI). The gene is localized on chromosome 6 with reported cytogenetic location 6p21.1.

CPS 18 corresponds to IL1RN which encodes interleukin 1 receptor antagonist. The gene has LocusID: 3557, and is localized on chromosome 2 with reported cytogenetic location 2q14.2. The gene product can bind to and inhibit the IL-1 receptor. The gene product is a member of the interleukin-1 (IL-1) family.

CPS 19 corresponds to LILRB3 which encodes leukocyte immunoglobulin-like receptor, subfamily B (with TM and ITIM domains), member 3. The gene has LocusID: 11025, and is localized at chromosome 19 with reported cytogenetic location 19q13.4. The gene product may play a role in regulation of immune responses. It is a member of the immunoglobulin superfamily.

CPS 19 also shows about 99% sequence identity to LOC163021. LOC163021 encodes a protein similar to immunoglobulin-like transcript 5. The gene is localized on chromosome 19 with reported cytogenetic location 19q13.42.

CPS 20 corresponds to FOXO3A which encodes forkhead box O3A. The gene has LocusID: 2309, and is localized at chromosome 6 with reported cytogenetic location 6q21. The gene product belongs to the forkhead family of transcription factors which are characterized by a distinct forkhead domain. This gene may function as a trigger for apoptosis through expression of genes necessary for cell death. Translocation of this gene with the MLL gene may be associated with secondary acute leukemia.

Nucleotides 1-3183 of SEQ ID NO: 245 (AF032886) share at least 99% sequence identity to FOXO3A. Consequently, SEQ ID NO: 245 can be used to design probes for detecting the expression of FOXO3A. Nucleotides 672 to 3182 of SEQ ID NO: 245 also have 98% sequence identity to LOC147167. LOC147167 is similar to bA653O20.1 (forkhead box O3A (forkhead Drosophila homolog like 1, FKHRL1)). LOC147167 is localized on chromosome 17 with reported cytogenetic location 17p11.1.

CPS 21 corresponds to ANXA5 which encodes annexin A5. The gene has LocusID: 308, and is localized on chromosome 4 with reported cytogenetic location 4q28-q32. The gene product belongs to the annexin family of calcium-dependent phospholipid binding proteins, some of which have been implicated in membrane-related events along exocytotic and endocytotic pathways. The, gene product is a phospholipase A2 and protein kinase C inhibitory protein with calcium channel activity and a potential role in cellular signal transduction, inflammation, growth and differentiation. The gene product has also been described as placental anticoagulant protein I, vascular anticoagulant-alpha, endonexin II, lipocortin V, placental protein 4 and anchorin CII. The gene contains at least 13 exons, and encodes at least one transcript of approximately 1.6 kb and at least one protein product with a molecular weight of about 35 kDa.

CPS 22 corresponds to SLC17A7 which encodes solute carrier family 17 (sodium-dependent inorganic phosphate cotransporter), member 7. The gene has LocusID: 57030, and is localized on chromosome 19 with reported cytogenetic location 19q13. The protein encoded by this gene is highly similar to brain specific sodium-dependent inorganic phosphate cotransporter [R.norvegicus]. The protein is a vesicle-bound, sodium-dependent phosphate transporter. It may be associated with the membranes of synaptic vesicles and function in glutamate transport. The protein shares 82% identity with the differentiation associated Na-dependent inorganic phosphate cotransporter.

CPS 23 corresponds to LOC51172 (APAA) which encodes N-acetylglucosamine-1-phosphodiester alpha-N-acetylglucosaminidase. The gene has LocusID: 51172, and is localized on chromosome 16 with reported cytogenetic location 16p13.13. N-acetylglucosamine-1-phosphodiester alpha-N-acetylglucosaminidase (phosphodiester alpha-GlcNAcase) catalyzes the second step in the synthesis of mannose 6-phosphate, and may be involved in forming the mannose 6-phosphate recognition signal on lysosomal enzymes.

CPS 24 corresponds to MPP1 which encodes membrane protein, palmitoylated 1 (55 kD). The gene has LocusID: 4354, and is localized on chromosome X with reported cytogenetic location Xq28. Palmitoylated membrane protein 1 is the prototype of a family of membrane-associated proteins termed MAGUKs (membrane-associated guanylate kinase homologs). MAGUKs interact with the cytoskeleton and regulate cell proliferation, signaling pathways, and intracellular junctions. Palmitoylated membrane protein 1 contains a conserved sequence, called the SH3 (src homology 3) motif, which is found in several other proteins that associate with the cytoskeleton and is suspected to play important roles in signal transduction. Palmitoylated membrane protein 1 is similar to Drosophila dlg (a tumor suppressor) and guanylate kinases.

CPS 25 corresponds to TPM1 which encodes tropomyosin 1 (alpha). The gene has LocusID: 7168, and is localized on chromosome 15 with reported cytogenetic location 15q22.1. Alpha-tropomyosin 1 binds to actin and troponin, and is a member of a family of actin-binding and troponin-binding proteins.

CPS 26 corresponds to UNK_M62896 which shows about 99% sequence identity with the non-protein coding strand of TRIM2 gene. TRIM2 encodes tripartite motif-containing 2, and has LocusID: 23321 with reported cytogenetic location 4q31.23.

CPS 26 shows about 86-90% sequence similarity to LOC221025 and ANXA2P2. LOC221025 is a hypothetical gene supported by M62895. LOC221025 is localized on chromosome 10. ANXA2P2 is localized on chromosome 9, and encodes annexin A2 pseudogene 2. In addition, CPS 26 has 91-93% sequence identity with two exons of ANXA2. ANXA2 encodes annexin A2, and has LocusID: 302 with reported cytogenetic location 15q21-q22.

CPS 27 corresponds to CSF2 which encodes colony stimulating factor 2 (granulocyte-macrophage). The gene has LocusID: 1437, and is localized on chromosome 5 with reported cytogenetic location 5q31.1. Granulocyte-macrophage colony stimulating factor 2 regulates hematopoietic cell differentiation, gene expression, and growth.

CPS 28 corresponds to LHFPL2 which encodes lipoma HMGIC fusion partner-like 2. The gene has LocusID: 10184, and is localized on chromosome 5 with reported cytogenetic location 5q13.3. Part of CPS 28 has about 90% sequence identity to LOC220397. LOC220397 encodes high mobility group protein 4 (HMG-4) (High mobility group protein 2a) (HMG-2a), and is localized on chromosome 11 with reported cytogenetic location 11q14.2.

CPS 29 corresponds to PARVB which encodes parvin, beta. The gene has LocusID: 29780, and is localized on chromosome 22 with reported cytogenetic location 22q13.2-q13.33. The gene product is also known as CGI-56 protein.

CPS 30 corresponds to MUC1 which encodes mucin 1, transmembrane. The gene has LocusID: 4582, and is localized on chromosome 1 with reported cytogenetic location 1q21. MUC1 gene product is a cell surface transmembrane glycoprotein. Alterations in glycosylation have been observed in epithelial cancer cells. MUC1 gene contains at least seven exons, and several alternatively spliced variants have been reported.

CPS 30 also has at least 99% sequence identity to LOC245755, which is a hypothetical gene supported by NM_002456 and X52228. LOC245755 is localized within MUC1.

CPS 31 corresponds to MARCO which encodes macrophage receptor with collagenous structure. The gene has LocusID: 8685, and is localized on chromosome 2 with reported cytogenetic location 2q12-q13. The gene protein has a collagenous structure that contains a bacteria-binding region.

CPS 32 corresponds to DRD2 which encodes dopamine receptor D2. The gene has LocusID: 1813, and is localized on chromosome 11 with reported cytogenetic location 11q23. This gene encodes the D2 subtype of the dopamine receptor. This G-protein coupled receptor can increase potassium channel activity, and inhibit adenylyl cyclase, calcium flux and phospholipid turnover. A missense mutation in this gene causes myoclonus dystonia. Other mutations have been associated with schizophrenia. Alternative splicing of this gene results in two transcript variants encoding different isoforms. A third variant has been described, but it has not been determined whether this form is normal or due to aberrant splicing.

CPS 33 corresponds to PPY which encodes pancreatic polypeptide. The gene has LocusID: 5539, and is localized on chromosome 17 with reported cytogenetic location 17q21. The gene product is a precursor of the pancreatic polypeptide and pancreatic icosapeptide. Mature pancreatic peptide can inhibit pancreatic exocrine function.

CPS 34 corresponds to AQP9 which encodes aquaporin 9. The gene has LocusID: 366, and is localized on chromosome 15 with reported cytogenetic location 15q22.1-22.2. The aquaporins/major intrinsic protein are a family of water-selective membrane channels. Aquaporin 9 has greater sequence similarity with AQP3 and AQP7, and they may be a subfamily. Aquaporin 9 allows passage of a wide variety of noncharged solutes. Aquaporin 9 stimulates urea transport and osmotic water permeability. There are contradicting reports about its role in providing glycerol permeability. Aquaporin 9 may also have some role in specialized leukocyte functions such as immunological response and bactericidal activity. Aquaporin 9 is expressed in leukocytes CPS 35 corresponds to APS which encodes adaptor protein with pleckstrin homology and src homology 2 domains. The gene has LocusID: 10603, and is localized on chromosome 7 with reported cytogenetic location 7q22. The APS protein, expressed in B lymphocytes, contains pleckstrin homology and src homology 2 (SH2) domains. In Burkitt lymphoma cell lines, it is tyrosine phosphorylated in response to B cell receptor stimulation. Because it binds Shc independent of stimulation and Grb2 after stimulation, it appears to play a role in signal transduction from the receptor to Shc/Grb2. It may link activated tyrosine kinases to signaling pathways.

CPS 36 corresponds to ALAS2 which encodes aminolevulinate, delta-, synthase 2 (sideroblastic/hypochromic anemia). The gene has LocusID: 212, and is localized on chromosome X with reported cytogenetic location Xp11.21. The ALAS2 gene product catalyzes the first step in the heme biosynthetic pathway. A second delta-aminolevulinate synthase gene (ALAS1) is located on chromosome 3 and is expressed in various tissues. A defective ALAS2 gene may cause X-linked pyridoxine-responsive sideroblastic anemia (Hypochromic Anemia). The gene product is also known as erythroid-specific delta-aminolevulinate synthase.

CPS 36 has about 99% sequence identity to LOC203568. LOC203568 encodes a protein similar to 5-aminolevulinic acid synthase, erythroid-specific, mitochondrial precursor (Delta-aminolevulinate synthase) (Delta-ALA synthetase) (ALAS-E). The gene is located on chromosome X with reported cytogenetic location Xp11.22.

CPS 37 corresponds to CTSL which encodes cathepsin L. The gene has LocusID: 1514, and is located on chromosome 9 with reported cytogenetic location 9q21-q22. The gene product is a lysosomal cysteine (thiol) protease that can cleave collagen and elastin.

CPS 37 has about 80-90% sequence identity to certain other genes. These genes include LOC118945, LOC119215 and LOC219343. LOC118945 is similar to Cathepsin L precursor (Major excreted protein) (MEP). It is located on chromosome 10 with reported cytogenetic location 10q23.32. LOC119215 is also similar to Cathepsin L precursor (Major excreted protein) (MEP). It has reported cytogenetic location 10q21.1. LOC219343 has reported cytogenetic location 10q23.2.

CPS 38 corresponds to DKFZP586E1621 which encodes Ras-induced senescence 1. The gene has LocusID: 25907, and is located on chromosome 3 with reported cytogenetic location 3p21.3. The gene is also known as RIS1.

CPS 39 corresponds to PRO2389 which encodes a hypothetical protein. The gene has LocusID: 80344, and is localized on chromosome 14 with reported cytogenetic location 14q11.2. The gene product is weakly similar to a 38 kDa splicing factor [H.sapiens].

CPS 40 corresponds to BLVRB which encodes biliverdin reductase B (flavin reductase (NADPH)). The gene has LocusID: 645, and is located on chromosome 19 with reported cytogenetic location 19q13.1-q13.2.

CPS 41 corresponds to GNA13 which encodes guanine nucleotide binding protein (G protein), alpha 13. The gene has LocusID: 10672, and is located on chromosome 17 with reported cytogenetic location 17q22-q24. The gene product is a component of heterotrimeric G-protein complexes.

CPS 41 shows about 75-80% sequence similarity to a genomic sequence near LOC130117. LOC130117 is similar to zinc finger protein 10 (KOX 1), and located on chromosome 2 with reported cytogenetic location 2p11.2.

CPS 42 corresponds to MAP2K3 which encodes mitogen-activated protein kinase kinase 3. The gene has LocusID: 5606, and is located on chromosome 17 with reported cytogenetic location 17q11.2. The protein encoded by this gene is a dual specificity protein kinase that belongs to the MAP kinase kinase family. This kinase can be activated by mitogenic and environmental stress, and may participate in the MAP kinase mediated signaling cascade. It can phosphorylate and thus activate MAPK14/p38-MAPK. This kinase can also be activated by insulin, and may be necessary for the expression of glucose transporter. Expression of RAS oncogene is found to result in the accumulation of the active form of this kinase, which thus leads to the constitutive activation of MAPK14, and confers oncogenic transformation of primary cells. The inhibition of this kinase is involved in the pathogenesis of *Yersina pseudotuberculosis*. Three alternatively spliced transcript variants of this gene encoding distinct isoforms have been reported.

CPS 42 has about 96-98% sequence identity to LOC146732. LOC146732 is similar to MAP kinase kinase 3b, and has reported cytogenetic location 17p13.1.

CPS 43 corresponds to BASP1 which encodes brain abundant, membrane attached signal protein 1. The gene has LocusID: 10409, and is located on chromosome 5 with reported cytogenetic location 5p15.1-p14. Nucleotides 433 to 554 of AA135683 also has 91% sequence identity to putative gene LOC222467 which is located on chromosome 13 with reported cytogenetic location 13q12.11.

CPS 44 corresponds to BNIP3L which encodes BCL2/adenovirus E1B 19 kD interacting protein 3-like. The gene has LocusID: 665, and is located on chromosome 8 with reported cytogenetic location 8p21. This gene is a member of the BCL2/adenovirus E1B 19 kd-interacting protein (BNIP) family. BNIP3L gene product can interact with the E1B 19 kDa protein which is responsible for the protection of virally-induced cell death. The gene product is a functional homolog of BNIP3, a proapoptotic protein. The gene product may function simultaneously with BNIP3 and play a role in tumor suppression. The gene product can also bind cellular Bcl2 or Bcl2L1, and may promote apoptosis.

CPS 45 corresponds to DBP which encodes D site of albumin promoter (albumin D-box) binding protein. The gene has LocusID: 1628, and is located on chromosome 19 with reported cytogenetic location 19q13.3. The gene product may function as a transcription factor and play a role in the diurnal regulation of liver-specific genes. It is a member of the PAR (proline and acidic amino acid-rich) b/ZIP family.

CPS 46 corresponds to BACH (hBACH) which encodes brain acyl-CoA hydrolase. The gene has LocusID: 11332, and is located on chromosome 1 with reported cytogenetic location 1p36.31-p36.11. The gene product is a member of the acyl coenzyme family. It can hydrolyze the CoA thioester of palmitoyl-CoA and other long-chain fatty acids. The gene product is also known as cytosolic acyl coenzyme A thioester hydrolase.

Nucleotides 76-1101 of SEQ ID NO: 46 (U91316) have about 89% sequence identity to LOC132927 which encodes a protein similar to cytosolic acyl coenzyme A thioester hydrolase (Long chain acyl-CoA thioester hydrolase) (CTE-II) (Brain acyl-CoA hydrolase) (BACH). LOC132927 is located on chromosome 4 with reported cytogenetic location 4p14.

CPS 47 corresponds to DGAT1 which encodes diacylglycerol O-acyltransferase homolog 1 (mouse). The gene has LocusID: 8694, and is located on chromosome 8 with reported cytogenetic location 8qter. The enzyme encoded by this gene utilizes diacylglycerol and fatty acyl CoA as substrates in order to catalyze the final stage of triacylglycerol synthesis. It is also involved in cellular as well as physiological metabolic processes.

CPS 48 corresponds to GUK1 which encodes guanylate kinase 1. The gene has LocusID: 2987, and is located on chromosome 1 with reported cytogenetic location 1q32-q41. The gene product can convert GMP to GTP as part of the cGMP cycle.

CPS 49 corresponds to IL10RB which encodes interleukin 10 receptor, beta. The gene has LocusID: 3588, and is located on chromosome 21 with reported cytogenetic location 21q22.11. Interleukin 10 receptor beta subunit transduces a signal upon binding of interleukin-10 (IL10). It is a class II member of the cytokine receptor family (CRF2).

The chromosomal region that aligns to CPS 49 is also located 3' to the polypeptide-coding sequence of IFNAR2. IFNAR2 encodes interferon (alpha, beta and omega) receptor 2. The gene has LocusID: 3455, and is located on chromosome 21 with reported cytogenetic location 21q22.11.

CPS 50 corresponds to ENPP2 (PDNP2) which encodes ectonucleotide pyrophosphatase/phosphodiesterase 2 (autotaxin). The gene has LocusID: 5168, and is located on chromosome 8 with reported cytogenetic location 8q24.1. Autotaxin is a potent tumor cell motility-stimulating protein. The gene product is also known as phosphodiesterase 1/nucleotide pyrophosphatase 2 (autotaxin).

Nucleotides 375-452, 1241-1277, 1576-1761 and 1399-1488 of SEQ ID NO: 50 (D45421) also have 97-100% sequence identity to a genomic sequence near LOC206890 on chromosome 8. LOC206890 is similar to cytochrome c (somatic) and has reported cytogenetic location 8q12.3.

CPS 51 corresponds to SLC5A6 which encodes solute carrier family 5 (sodium-dependent vitamin transporter), member 6. The gene has LocusID: 8884, and is located on chromosome 2 with reported cytogenetic location 2p23. The gene product functions in the transplacental transfer of pantothenate biotin and lipoate. Nucleotides 962 to 1314 of SEQ ID NO: 51 (AL096737) has about 90% identity to TCF23 (LocusID: 150921) which encodes transcription factor 23 and is located on chromosome 2 with reported cytogenetic location 2p23.3.

CPS 52 corresponds to GPR3 which encodes G protein-coupled receptor 3. The gene has LocusID: 2827, and is located on chromosome 1 with reported cytogenetic location 1p36.1-p35. The gene product can activate adenylate cyclase in cell lines, and is a member of the G protein-coupled receptor family.

CPS 53 corresponds to SOD2 which encodes superoxide dismutase 2, mitochondrial. The gene has LocusID: 6648, and is located on chromosome 6 with reported cytogenetic location 6q25.3. The gene product is an intramitochondrial free radical scavenging enzyme, and has strong similarity to murine Sod2.

CPS 54 corresponds to TREX1 which encodes three prime repair exonuclease 1. The gene has LocusID: 11277, and is located on chromosome 3 with reported cytogenetic location 3p21.3-p21.2. This gene uses at least two different open reading frames. The upstream ORF encodes proteins which interact with the ataxia telangiectasia and Rad3 related protein, a checkpoint kinase. The proteins encoded by this upstream ORF localize to intranuclear foci following DNA damage and may be importatnt components of the DNA damage checkpoint. The downstream ORF encodes proteins with 3' exonuclease activity. Other enzymes with this activity are involved in DNA replication, repair, and recombination. Similarity to an *E. coli* protein suggests that the enzymes encoded by this ORF may be a subunit of DNA polymerase III, which does not have intrinsic exonuclease activity. Both ORFs are subject to alternative splicing, resulting in at least six transcript variants.

CPS 54 also has about 99% sequence identity to at least parts of LOC200884 and LOC152456. Both genes are located within TREX1. LOC200884 encodes protein(s) similar to three prime repair exonuclease 1 (isoform b), 3 repair exonuclease 1, deoxyribonuclease III (dnaQ/mutD (E. coli)-like), and ATR interacting protein. LOC200884 has reported cytogenetic location 3p21.31. LOC152456 encodes protein(s) similar to three prime repair exonuclease 1 (isoform b), 3 repair exonuclease 1, deoxyribonuclease III (dnaQ/mutD (E. coli)-like), and ATR interacting protein. It has reported cytogenetic location 3p21.31.

CPS 55 corresponds to WNT6 which encodes wingless-type MMTV integration site family, member 6. The gene has LocusID: 7475, and is located on chromosome 2 with reported cytogenetic location 2q35. The WNT gene family consists of structurally related genes which encode secreted signaling proteins. These proteins have been implicated in oncogenesis and in several developmental processes, including regulation of cell fate and patterning during embryogenesis. This gene is a member of the WNT gene family. It is overexpressed in a cervical cancer cell line and strongly coexpressed with another family member, WNT10A, in a colorectal cancer cell line. The gene overexpression may play key roles in carcinogenesis. This gene and the WNT10A gene are clustered in the chromosome 2q35 region. The protein encoded by this gene is 97% identical to the mouse Wnt6 protein at the amino acid level.

CPS 56 corresponds to PIP5K2A which encodes phosphatidylinositol-4-phosphate 5-kinase, type II, alpha. The gene has LocusID: 5305, and is located on chromosome 10 with reported cytogenetic location 10p11.23. Phosphatidylinositol-4,5-bisphosphate, the precursor to second messengers of the phosphoinositide signal transduction pathways, is thought to be involved in the regulation of secretion, cell proliferation, differentiation, and motility. The protein encoded by this gene is one of a family of enzymes capable of catalyzing the phosphorylation of phosphatidylinositol-4-phosphate on the fifth hydroxyl of the myo-inositol ring to form phosphatidylinositol-4,5-bisphosphate. The gene product exhibits kinase activity. This gene is a member of the phosphatidylinositol-4-phosphate 5-kinase family. The gene product is also known as 1-phosphatidylinositol-4-phosphate-5-kinase isoform C.

CPS 57 corresponds to FABP5 which encodes fatty acid binding protein 5 (psoriasis-associated). FABP5 gene has LocusID: 2171, and is located on chromosome 8 with reported cytogenetic location 8q21.13. The gene encodes the fatty acid binding protein found in epidermal cells, and was identified as being upregulated in psoriasis tissue. Fatty acid binding proteins are a family of small, highly conserved, cytoplasmic proteins that bind long-chain fatty acids and other hydrophobic ligands. It is thought that fatty acid binding proteins are involved in fatty acid uptake, transport, and metabolism. FABP5 gene product binds to stearic acid and may have a role in keratinocyte differentiation.

CPS 57 also shows 100% sequence alignment with an intron sequence of STX3A which encodes syntaxin 3A. The gene has LocusID: 6809, and is located on chromosome 11 with reported cytogenetic location 11q12.3. Syntaxin 3A is involved in intracellular protein transport.

In addition, CPS 57 has about 95-97% sequence identity to LOC95551, LOC220113, LOC114948, LOC220832, and LOC150161. LOC95551 is similar to fatty acid-binding protein, epidermal (E-FABP) (psoriasis-associated fatty acid-binding protein homolog) (PA-FABP). LOC95551 is located on chromosome 13 with reported cytogenetic location 13q21.33. LOC220113 encodes fatty acid-binding protein, epidermal (E-FABP) (psoriasis-associated fatty acid-binding protein homolog) (PA-FABP). LOC220113 has reported cytogenetic location 13q14.13. LOC220113 is within an intron of ATP7B which encodes ATPase, Cu++ transporting, beta polypeptide (Wilson disease), and has LocusID: 540.

LOC114948 encodes a protein similar to fatty acid-binding protein, epidermal (E-FABP) (psoriasis-associated fatty acid-binding protein homolog) (PA-FABP). It is located on chromosome 15 with reported cytogenetic location 15q25.3. LOC220832 also encodes a protein similar to fatty acid-binding protein, epidermal (E-FABP) (psoriasis-associated fatty acid-binding protein homolog) (PA-FABP). It has reported cytogenetic location 7q36.1. Similarly, LOC150161 encodes a protein similar to fatty acid-binding protein, epidermal (E-FABP) (psoriasis-associated fatty acid-binding protein homolog) (PA-FABP). It is located on chromosome 22 with reported cytogenetic location 22q11.1.

Furthermore, CPS 57 has about 89-93% sequence identity to BTBD1, LOC130962, LOC152940 and LOC204114. BTBD1 encodes BTB (POZ) domain containing 1. It has LocusID: 53339, and is located on chromosome 15 with reported cytogenetic location 15q24. The gene product contains a BTB/POZ domain, and may function as DNA or actin binding protein. LOC130962 encodes a protein similar to fatty acid binding protein, epidermal (E-FABP) (psoriasis-associated fatty acid-binding protein homolog) (PA-FABP). The gene has reported cytogenetic location 2q23.3. Likewise, LOC152940 encodes a protein similar to unnamed protein product. It is located on chromosome 4 with reported cytogenetic location 4q31.3-q32.1. LOC204114 encodes a protein similar to fatty acid binding protein homolog. It has reported cytogenetic location 13q31.3.

CPS 58 corresponds to MMP9 which encodes matrix metalloproteinase 9 (gelatinase B, 92 kD gelatinase, 92 kD type IV collagenase). The gene has LocusID: 4318, and is located on chromosome 20 with reported cytogenetic location 20q11.2-q13.1. Proteins of the matrix metalloproteinase (MMP) family are involved in the breakdown of extracellular matrix in normal physiological processes, such as embryonic development, reproduction, and tissue remodeling, as well as in disease processes, such as arthritis and metastasis. Most MMPs are secreted as inactive proproteins which are activated when cleaved by extracellular proteinases. The enzyme encoded by this gene can degrade type IV and V collagens. Studies in rhesus monkeys suggest that the enzyme is involved in IL-8-induced mobilization of hematopoietic progenitor cells from bone marrow, and murine studies suggest a role in tumor-associated tissue remodeling.

CPS 59 corresponds to ATP2B 1 which encodes ATPase, Ca++ transporting, plasma membrane 1. The gene has LocusID: 490, and is located on chromosome 12 with reported cytogenetic location 12q21-q23.

Nucleotides 2623 to 2814 of SEQ ID NO: 59 (J04027) have about 81% sequence identity to ATP2B4 which encodes ATPase, Ca++ transporting, plasma membrane 4. ATP2B4 has LocusID: 493, and is located on chromosome 1. Nucleotides 4365-4398 of SEQ ID NO: 59 has 100% sequence identity to FLJ14075 which encodes hypothetical protein FLJ14075. FLJ14075 has LocusID: 79954, and is located on chromosome 2.

CPS 60 corresponds to NEUD4 which encodes neuro-d4 (rat) homolog. The gene has LocusID: 8193, and is located on chromosome 19 with reported cytogenetic location 19q13.13. The gene product contains at least a zinc finger DNA binding domain. Nucleotides 61-198 of U43843 has 86% sequence identity to CERD4 which encodes cer-d4 (mouse) homolog. CERD4 has LocusID: 8110, and is located on chromosome 14 with reported cytogenetic location 14q24.3-q31.1.

CPS 61 corresponds to CCR1 which encodes chemokine (C-C motif) receptor 1. The gene has LocusID: 1230, and is located on chromosome 3 with reported cytogenetic location 3p21. The gene products is a member of the beta chemokine receptor family, and is predicted to be a seven transmembrane protein similar to G protein-coupled receptors. The ligands of this receptor include macrophage inflammatory protein 1 alpha (MIP-1 alpha), monocyte chemoattractant protein 3 (MCP-3), and myeloid progenitor inhibitory factor-1 (MPIF-1). Signal transduction mediated by chemokines and their receptors is believed to be important for the recruitment of effector immune cells to the site of inflammation. Knockout studies of the mouse homolog suggests the role of this gene in host protection from inflammatory response, and susceptibility to virus and parasite. This gene and other chemokine receptor genes, including CCR2, CCRL2, CCR3, CCR5 and CCXCR1, are found to form a gene cluster on chromosome 3p. The protein encoded by this gene can bind to chemokines of the CC subfamily and mediate intracellular calcium flux.

CPS 62 corresponds to C8FW which encodes a phosphoprotein regulated by mitogenic pathways. The protein is similar to protein kinases. The gene has LocusID: 10221, and is located on chromosome 8 with reported cytogenetic location 8q24.13.

CPS 63 corresponds to CLU which encodes clusterin (complement lysis inhibitor, SP-40,40, sulfated glycoprotein 2, testosterone-repressed prostate message 2, apolipoprotein J). The gene has LocusID: 1191, and is located on chromosome 8 with reported cytogenetic location 8p21-p12. Clusterin is a glycoprotein and can be found in high density lipoproteins and endocrine and neuronal granules. It may have a role in the terminal complement reaction.

CPS 64 corresponds to EREG which encodes epiregulin. The gene has LocusID: 2069, and is located on chromosome 4 with reported cytogenetic location 4q13.3. Epiregulin is a member of the epidermal growth factor family. Epiregulin can function as a ligand of EGFR (epidermal growth factor receptor), as well as a ligand of members of the ERBB (v-erb-b2 oncogene homolog) family of tyrosine-kinase receptors. Epiregulin may promote cell proliferation.

CPS 65 corresponds to PPAP2B which encodes phosphatidic acid phosphatase type 2B. The gene has LocusID: 8613, and is located on chromosome 1 with reported cytogenetic location 1pter-p22.1. The gene product is magnesium-independent phosphatidic acid phosphatase 2b. It can convert phosphatidic acid to diacylglycerol. It can also hydrolyze lysophosphatidate, ceramide-1-phosphate, and sphingosine-1-phosphate.

CPS 66 corresponds to TUBB which encodes tubulin, beta polypeptide. The gene has LocusID: 7280, and is located on chromosome 6 with reported cytogenetic location 6p21.3. Beta tubulin can polymerize to form microtubules. It is a member of a family of structural proteins.

Nucleotides 119-231 and 340-939 of SEQ ID NO: 66 (X79535) also have over 99% sequence identity to a genomic sequence between TUBB and LOC221753. LOC221753 is located on chromosome 6.

In addition, nucleotides 58-120 and 340-1397 of X79535 have about 98% sequence identity to LOC221753. LOC221753 has reported cytogenetic location 6p24.3.

Moreover, fragments of X79535 exhibit about 82-92% sequence identity to certain other genes. These genes include TUBB5, TUBB4, LOC139112, LOC157586, LOC203068, LOC92755 and GABRR2. TUBB5 encodes tubulin, beta, 5. It has LocusID: 10382, and is located on chromosome 19 with reported cytogenetic location 19p13.3. TUBB5 gene has nucleotides 637115 to 644163 of chromosome 19. Beta 5-tubulin can polymerize to form microtubules. TUBB4 encodes tubulin, beta, 4. It has LocusID: 10381, and is located on chromosome 16 with reported cytogenetic location 16q24.3. Beta 4 tubulin can also polymerize to form microtubules. LOC139112 encodes a protein similar to tubulin beta. The gene has reported cytogenetic location Xq25. LOC157586 and LOC203068 encode proteins similar to hypothetical protein DKFZp564N123.1-human (fragment). Both genes have reported cytogenetic location 8p21.1. LOC92755 is a hypothetical gene, and has reported cytogenetic location 8p21.1. GABRR2 encodes gamma-aminobutyric acid (GABA) receptor, rho 2. It has LocusID: 2570 and reported cytogenetic location 6q13-q16.3. GABA is a major inhibitory neurotransmitter in the mammalian brain where it can act at GABA receptors, which are ligand-gated chloride channels. GABRR2 is a member of the rho subunit family.

CPS 67 corresponds to NUP214 which encodes nucleoporin 214 kD (CAIN). The gene has LocusID: 8021, and is located on chromosome 9 with reported cytogenetic location 9q34.1. Nucleoporin 214 kD is a protein localized to cytoplasmic aspect of the nuclear pore complex. It contains FXFG repeats.

Fragment of nucleotides 3712 to 5515 of D14689 (SEQ ID NO: 67) has 100% sequence identity to LOC158306. LOC158306 encodes a protein similar to nucleoporin 214 kD (CAIN), and has reported cytogenetic location 9q34.2. LOC158306 is located within an exon of NUP214 gene.

CPS 68 corresponds to ALDH5A1 which encodes aldehyde dehydrogenase 5 family, member A1 (succinate-semialdehyde dehydrogenase). The gene has LocusID: 7915, and is located on chromosome 6 with reported cytogenetic location 6p22. CPS 68 aligns to nucleotides 32909278 to 32909817 of chromosome 6, and is located in the 3' untranslated region of ALDH5A1. Aldehyde dehydrogenase 5A1 (succinic semialdehyde dehydrogenase) involves 4-aminobutyric acid degradation.

Nucleotides 45212 to 44763 of SEQ ID NO: 68 (AL031230) have about 90% sequence identity to HSPCAL3 which encodes heat shock 90 kD protein 1, alpha-like 3. HSPCAL3 gene has LocusID: 3324 and reported cytogenetic location 11p14.2-p14.1. In addition, nucleotides 11858 to 12096 of AL031230 show 86% sequence identity to a genomic sequence on chromosome 1.

CPS 69 corresponds to LOC64116. The gene has LocusID: 64116, and is located on chromosome 4 with reported cytogenetic location 4q22-q24. The gene is up-regulated by BCG-CWS.

CPS 70 corresponds to XK which encodes Kell blood group precursor (McLeod phenotype). The gene has LocusID: 7504, and is located on chromosome X with reported cytogenetic location Xp21.1. This locus controls the synthesis of the Kell blood group "recursor substance" Kx). Mutations in this gene have been associated with McLeod syndrome, an X-linked, recessive disorder characterized by abnormalities in the neuromuscular and hematopoietic systems. The encoded protein is a member of transporter family and has structural characteristics of prokaryotic and eukaryotic membrane transport proteins.

CPS 71 corresponds to KIAA0837 (FACL6) which encodes long fatty acyl CoA synthetase 2 gene (fatty-acid-Coenzyme A ligase, long-chain 6). The gene has LocusID: 23305, and is located on chromosome 5 with reported cytogenetic location 5q31.

CPS 72 corresponds to GYPC which encodes glycophorin C (Gerbich blood group). The gene has LocusID: 2995, and is located on chromosome 2 with reported cytogenetic location 2q14-q21. Glycophorin C (GYPC) is an integral membrane glycoprotein. It is a minor species carried by human erythrocytes, but plays an important role in regulating the mechanical stability of red cells. A number of glycophorin C mutations have been described. The Gerbich and Yus phenotypes are due to deletion of exon 3 and 2, respectively. The Webb and Duch antigens, also known as glycophorin D, result from single point mutations of the glycophorin C gene. The glycophorin C protein has homology with glycophorins A and B.

CPS 73 corresponds to TFDP1 which encodes transcription factor Dp-1. The gene has LocusID: 7027, and is located on chromosome 13 with reported cytogenetic location 13q34. The gene product may heterodimerize with E2F to transactivate genes involved in cell cycle progression from G1 to S-phase. TFDP1, CUL4A, and CDC16 are probable targets of an amplification mechanism and may be involved, together or separately, in development and/or progression of some hepatocellular carcinomas.

CPS 73, as well as nucleotides 9 to 1440 of L23959 (SEQ ID NO: 73), have about 95% sequence identity to LOC245788 on chromosome 8. LOC245788 is reported to encode transcription factor DP-1 (E2F dimerization partner 1) (DRTF1-polypeptide-1) (DRTF1).

In addition, CPS 73 has about 87-90% sequence identity to LOC126611 and LOC51270. LOC126611 encodes a protein similar to transcription factor DP-1 (E2F dimerization partner 1) (DRTF1-polypeptide-1) (DRTF1). It is located on chromosome 1 with reported cytogenetic location 1q31.3. LOC51270 encodes E2F-like protein which is similar to a region of human transcription factor Dp-1. The gene has LocusID: 51270, and is located on chromosome X with reported cytogenetic location Xq26.2.

Nucleotides 1001 to 1440 of SEQ ID NO: 73 (L23959) have about 87% sequence identity to CD36 which encodes CD36 antigen (collagen type I receptor, thrombospondin receptor). The gene has LocusID: 948, and is located on chromosome 7 with reported cytogenetic location 7q11.2. CD36 is a receptor for thrombospondin and collagen in platelets. It functions in cell adhesion. It has a role in platelet-collagen adhesion, and can bind to long chain fatty acids. The protein is strongly similar to rat FAT. Nucleotides 9 to 947 of SEQ ID NO: 73 have 95% sequence identity to LOC123471 which encodes a protein similar to transcription factor DP-1 (E2F dimerization partner 1) (DRTF1-polypeptide-1) (DRTF1). LOC123471 has reported cytogenetic location 15q23.

CPS 74 corresponds to C20orf16 which encodes chromosome 20 open reading frame 16. The gene has LocusID: 54498, and is located on chromosome 20 with reported cytogenetic location 20p13. The protein is a member of the flavin containing amine oxidase family. It is weakly similar to monoamine MAOB (oxidase B).

CPS 75 corresponds to FCAR which encodes a receptor for Fc fragment of IgA. The gene has LocusID: 2204, and is located on chromosome 19 with reported cytogenetic location 19q13.2-q13.4. This gene is a member of the immunoglobulin gene superfamily and encodes a receptor for the Fc region of IgA. The receptor is a transmembrane glycoprotein present on the surface of myeloid lineage cells such as neutrophils, monocytes, macrophages, and eosinophils, where it may mediate immunologic responses to pathogens. It may interact with IgA-opsonized targets and trigger several immunologic defense processes, including phagocytosis, antibody-dependent cell-mediated cytotoxicity, and stimulation of the release of inflammatory mediators. At least ten transcript variants encoding different isoforms have been described for this gene. The gene product is also known as Fc alpha R.

CPS 76 corresponds to ITGB3 which encodes integrin, beta 3 (platelet glycoprotein IIIa, antigen CD61). The gene has LocusID: 3690, and is located on chromosome 17 with reported cytogenetic location 17q21.32. The ITGB3 protein product is the integrin beta chain beta 3. Integrins are integral cell-surface proteins composed of an alpha chain and a beta chain. A given chain may combine with multiple partners resulting in different integrins. Integrin beta 3 is found along with the alpha IIb chain in platelets. Integrins are known to participate in cell adhesion as well as cell-surface mediated signaling. This gene product may be involved in mediating platelet aggregation.

CPS 77 corresponds to MXI1 which encodes MAX interacting protein. The gene has LocusID: 4601, and is located on chromosome 10 with reported cytogenetic location 10q24-q25. Expression of the c-myc gene, which produces an oncogenic transcription factor, is tightly regulated in normal cells but is frequently deregulated in human cancers. The protein encoded by this gene is a tranceriptional repressor thought to negatively regulate MYC function, and is therefore a potential tumor suppressor. The protein inhibits the transcriptional activity of MYC by competing for MAX, another basic helix-loop-helix protein that binds to MYC and is required for its function. Defects in this gene are frequently found in patients with prostate tumors. Two transcript variants encoding different isoforms have been identified for this gene.

Nucleotides 1 to 64 of SEQ ID NO: 77 (L07648) show 100% sequence identity to ARHA which encodes ras homolog gene family, member A. The gene has LocusID: 387, and is located on chromosome 3 with reported cytogenetic location 3p21.3. The gene product is a ras-related GTP binding protein of the rho subfamily, and may be involved in regulation of reorganization of the actin cytoskeleton.

CPS 78 corresponds to CSDA which encodes cold shock domain protein A. The gene has LocusID: 8531, and is located on chromosome 12 with reported cytogenetic location 12p13.1. The gene product is a member of a family of transcriptional regulators. It can bind and repress the promoter of the (GM-CSF) gene. The gene product contains a cold-shock domain.

CPS 78, as well as nucleotides 14 to 1568 of M24069 (SEQ ID NO: 78), show at least 94% sequence identity to LOC220558. LOC220558 also encodes cold shock domain protein A or cold-shock domain protein A. It is located on chromosome 16 with reported cytogenetic location 16p11.1.

CPS 79 corresponds to OPTN (FIP2) which encodes optineurin. The gene has LocusID: 10133, and is located on chromosome 10 with reported cytogenetic location 10p12.33. The gene product is a component of a heterodimeric complex that inhibits cytolysis induced by tumor necrosis factor alpha. It contains leucine zippers. It is also known as tumor necrosis factor alpha-inducible cellular protein containing leucine zipper domains or Huntingtin interacting protein L.

CPS 80 corresponds to SELENBP1 which encodes selenium binding protein 1. The gene has LocusID: 8991, and is located on chromosome 1 with reported cytogenetic location 1q21-q22. This gene product belongs to the selenium-binding protein family. Selenium is a nutrient that exhibits potent anticarcinogenic properties, and deficiency of selenium may cause certain neurologic diseases. It has been proposed that the effects of selenium in preventing cancer and neurologic diseases may be mediated by selenium-binding proteins. The exact function of this gene is not known.

CPS 81 corresponds to PPP1R2 which encodes protein phosphatase 1, regulatory (inhibitor) subunit 2. The gene has LocusID: 5504, and is located on chromosome 3 with reported cytogenetic location 3q29. Inhibitory subunit 2 of protein phosphatase 1 may associate with the gamma isoform of protein phosphatase 1.

Nucleotides 25 to 556 of SEQ ID NO: 81 (U68111) also have 96% sequence identity to LOC153743. This gene encodes a protein similar to protein phosphatase 1, regulatory (inhibitor) subunit 2. The gene has reported cytogenetic location 5q33.2.

In addition, nucleotides 25 to 556 of U68111 have 85-90% sequence identity to certain other genes or genomic sequences. These genes or genomic sequences include PPP1R2P1, the region 3' to LOC160817, the non-coding region of LOC130957, the non-coding region of LOC220419, and certain regions in chromosomes 7 and 21. PPP1R2P1 encodes protein phosphatase 1, regulatory (inhibitor) subunit 2 pseudogene 1. PPP1R2P1 has LocusID: 5505, and is located on chromosome 6 with reported cytogenetic location 6p21.1. LOC160817 encodes a protein similar to protein phosphatase 1, regulatory (inhibitor) subunit 2, and has reported cytogenetic location 13q21.1. LOC130957 encodes a protein similar to protein phosphatase 1, regulatory (inhibitor) subunit 2, and is located at chromosome 2q12.1. LOC220419 is reported to encode protein phosphatase 1, regulatory (inhibitor) subunit 2, and is located at chromosome 13q14.11.

CPS 82 corresponds to HPGD which encodes hydroxyprostaglandin dehydrogenase 15-(NAD). The gene has LocusID: 3248, and is located on chromosome 4 with reported cytogenetic location 4q34-q35. The gene product can inactivate many prostaglandins by oxidation of their C-15 residues.

CPS 83 corresponds to SLC4A1 which encodes solute carrier family 4, anion exchanger, member 1 (erythrocyte membrane protein band 3, Diego blood group). The gene has LocusID: 6521, and is located on chromosome 17 with reported cytogenetic location 17q21-q22. The genomic sequence aligning to CPS 83 is located 3' to the polypeptide-coding sequence of the gene. The gene is also known as CD233 gene. The gene product, also known as Band 3 anion exchanger, is part of the anion exchanger (AE) family. The gene product may function to maintain ion homeostasis by transporting chloride and bicarbonate ions.

SEQ ID NO: 259 (M27819) also aligns to SLC4A1 with over 98% sequence identity, and therefore, can be used as a probe for SLC4A1. Nucleotides 2206 to 2426 of SEQ ID NO: 259 also show about 76% sequence identity to SLC4A2. This gene encodes solute carrier family 4, anion exchanger, member 2 (erythrocyte membrane protein band 3-like 1). The gene has LocusID: 6522.

CPS 84 corresponds to IL17R which encodes interleukin 17 receptor. The gene has LocusID: 23765, and is located on chromosome 22 with reported cytogenetic location 22q11.1. The gene product is highly similar to murine Il17r, and may play a role in T cell activation and induction of IL-2 (IL2).

CPS 87 corresponds to CBFA2T3 which encodes core-binding factor, runt domain, alpha subunit 2; translocated to, 3. The gene has LocusID: 863, and is located on chromosome 16 with reported cytogenetic location 16q24. The gene product is a member of the MTG8 (ETO/CDR) protein family.

CPS 89 corresponds to an intron sequence of RAP1GA1. RAP1GA1 encodes GTPase activating protein 1 for rap1. RAP1GA1 gene has LocusID: 5909, and is located on chromosome 1 with reported cytogenetic location 1p36.1-p35. The gene product is also known as KIAA0474 gene product.

CPS 90 corresponds to BCL2L1, which encodes BCL2-like 1. The gene has LocusID: 598, and is located on chromosome 20 with reported cytogenetic location 20q11.1. The protein encoded by this gene belongs to the BCL-2 protein family. BCL-2 family members form hetero- or homodimers and act as anti- or pro-apoptotic regulators that are involved in a wide variety of cellular activities. The proteins encoded by this gene are located at the outer mitochondrial membrane, and have been shown to regulate outer mitochondrial membrane channel (VDAC) opening. VDAC regulates mitochondrial membrane potential, and thus controls the production of reactive oxygen species and release of cytochrome C by mitochondria, both of which are the potent inducers of cell apoptosis. At least two alternatively spliced transcript variants, which encode distinct isoforms, have been reported. The longer isoform may act as an apoptotic inhibitor and the shorter form may act as an apoptotic activator.

CPS 91 corresponds to COPEB which encodes core promoter element binding protein. The gene has LocusID: 1316, and is located on chromosome 10 with reported cytogenetic location 10p15. This gene encodes a nuclear protein (core promoter element binding protein). This protein has three zinc fingers at the end of its C-terminal domain, a serine/threonine-rich central region and an acidic domain lying within the N-terminal region. The zinc fingers of this protein are believed to be responsible for the specific DNA binding with the guanine-rich core promoter elements. The central region might be involved in activation or posttranslational regulatory pathways, and the acidic N-terminal domain might play an important role in the process of transcriptional activation. This protein is expressed in several tissues, with the high levels in the placenta. It is a trancriptional activator, capable of activating transcription approximately 4fold either on homologous or heterologous promoters. The DNA binding and transcriptional activity of this protein, in conjunction with its expression pattern, suggests that this protein may participate in the regulation and/or maintenance of the basal expression of pregnancy-specific glycoprotein gene and possibly other TATA box-less genes. The genomic sequence aligning to CPS 91 is located 3' to the polypepetide coding sequence of the gene.

CPS 92 corresponds to ADM which encodes adrenomedullin. The gene has LocusID: 133, and is located on chromosome 11 with reported cytogenetic location 11p15.4. Adrenomedullin, a hypotensive peptide found in human pheochromocytoma, consists of 52 amino acids, has one intramolecular disulfide bond, and shows a slight homology with the calcitonin gene-related peptide. It may function as a hormone in circulation control because it is found in blood in a considerable concentration. The precursor, called preproadrenomedullin, is 185 amino acids long. By RNA-blot analysis, human adrenomedullin mRNA was found to be highly expressed in several tissues. Genomic ADM DNA consists of at least 4 exons and 3 introns, with the 5-prime flanking region containing TATA, CAAT, and GC boxes. There are also multiple binding sites for activator protein-2 and a cAMP-regulated enhancer element. The gene also encodes the precursor of adrenomedullin (AM) and the putative 20 amino acid peptide proAM-N20. The gene product may regulate blood pressure and heart rate.

CPS 93 corresponds to SPTB which encodes spectrin, beta, erythrocytic (includes spherocytosis, clinical type I). The gene has LocusID: 6710, and is located on chromosome 14 with reported cytogenetic location 14q23-q24.2. Beta spectrin (beta-fodrin) may crosslink actin proteins of the membrane-associated cytoskeleton. It is a member of a family of actin-cross linking proteins.

CPS 94 corresponds to ITGA2B which encodes integrin, alpha 2b (platelet glycoprotein IIb of IIb/IIIa complex, antigen CD41B). The gene has LocusID: 3674, and is located on chromosome 17 with reported cytogenetic location 17q21.32. Integrins are heterodimeric integral membrane proteins composed of an alpha chain and a beta chain. Alpha chain 2b undergoes post-translational cleavage to yield disulfide-linked light and heavy chains that join with beta 3 to form a fibronectin receptor expressed in platelets that plays a crucial role in coagulation. Mutations that interfere with this role may result in thrombasthenia. In addition to adhesion, integrins are known to participate in cell-surface mediated signalling. The gene product can act as a receptor for fibrinogen, von Willebrand factor and fibronectin CPS 95 corresponds to CTNNAL1 which encodes catenin (cadherin-associated protein), alpha-like 1. The gene has LocusID: 8727, and is located on chromosome 9 with reported cytogenetic location 9q31.2. Alpha-like 1 catenin (cadherin-associated protein) links cadherins to the cytoskeleton. The protein is a member of the catenin family of cadherin-binding proteins.

CPS 96 corresponds to SCYA2 which encodes small inducible cytokine A2 (monocyte chemotactic protein 1). The gene has LocusID: 6347, and is located on chromosome 17 with reported cytogenetic location 17q11.2-q21.1. Cytokine A2 is a chemotactic factor for monocytes.

CPS 97 corresponds to NDUFB7 which encodes NADH dehydrogenase (ubiquinone) 1 beta subcomplex, 7 (18 kD, B18). The gene has LocusID: 4713, and is located on chromosome 19 with reported cytogenetic location 19q13.12-p13.11. The gene product is a subunit of the NADH-ubiquinone oxidoreductase (complex I).

CPS 98 corresponds to SCYA7 which encodes small inducible cytokine A7 (monocyte chemotactic protein 3). The gene has LocusID: 6354, and is located on chromosome 17 with reported cytogenetic location 17q11.2-q12. This gene encodes monocyte chemotactic protein 3, a secreted chemokine which attracts macrophages during inflammation and metastasis. It is a member of the C-C subfamily of chemokines which are characterized by having two adjacent cysteine residues. The protein is an in vivo substrate of matrix metalloproteinase 2, an enzyme which degrades components of the extracellular matrix. SCYA7 is part of a cluster of C-C chemokine family members on chromosome 17q.

Nucleotides 1 to 246 of SEQ ID NO: 95 (X72308) have about 95% sequence identity to at least two other genomic sequences. The first genomic sequence is located between the polypeptide-coding sequences of AMPD3 and ZFP26. The second genomic sequence is located near LOC139170. AMPD3 encodes adenosine monophosphate deaminase (isoform E), and has LocusID: 272. The gene is located at chromosome 11p15. ZFP26 encodes C3HC4-like zinc finger protein, and has LocusID: 50862. The gene is located at chromosome 11p15.3. LOC139170 encodes a protein similar to KIAA1892 protein, and is located at chromosome Xq25.

CPS 99 corresponds to FCGR1A which encodes Fc fragment of IgG, high affinity Ia, receptor for (CD64). The gene has LocusID: 2209, and is located on chromosome 1 with reported cytogenetic location 1q21.2-q21.3. The gene product has a role in immune response, and is a member of the immunoglobulin superfamily.

CPS 100 corresponds to EPB49 which encodes erythrocyte membrane protein band 4.9 (dematin). The gene has LocusID: 2039, and is located on chromosome 8 with reported cytogenetic location 8p21.1. Dematin may bind to actin. It is a member of the villin family of actin-bundling proteins.

CPS 101 corresponds to DD96 which encodes epithelial protein up-regulated in carcinoma, membrane associated protein 17. The gene has LocusID: 10158, and is located on chromosome 1 with reported cytogenetic location 1p33. The gene is reported to be up-regulated in malignant epithelial cells of renal cell carcinomas, as well as in carcinomas of colon, breast and lung.

Nucleotides 1 to 87 of SEQ ID NO: 98 (U21049) show about 98% sequence identity to LOC222094. LOC222094 encodes cell division cycle 2-like 5 (isoform 1), cholinesterase-related cell division controller, and CDC2-related protein kinase 5. It is located at chromosome 7p15.2.

CPS 102 corresponds to PPARG which encodes peroxisome proliferative activated receptor, gamma. The gene has LocusID: 5468, and is located on chromosome 3 with reported cytogenetic location 3p25. The protein encoded by this gene is a member of the peroxisome proliferator-activated receptor (PPAR) subfamily of nuclear receptors. PPARs form heterodimers with retinoid X receptors (RXRs) and these heterodimers regulate transcription of various genes. Three subtypes of PPARs are known: PPAR-alpha, PPAR-delta, and PPAR-gamma. The protein encoded by this gene is PPAR-gamma and is a regulator of adipocyte differentiation. Additionally, PPAR-gamma has been implicated in the pathology of numerous diseases including obesity, diabetes, atherosclerosis and cancer. Multiple transcript variants that use alternate promoters and splicing have been identified for this gene. At least three of these variants encode the same isoform.

Nucleotides 1 to 77 of SEQ ID NO: 99 (L40904) have 100% sequence identity to HBA2. HBA2 encodes hemoglobin, alpha 2, and has LocusID: 3040. The gene is located at chromosome 16 with reported cytogenetic location 16p13.3.

Affymetrix annotation suggests that CPS 103 corresponds to SPINK1. Blast search against the Entrez human genome database shows that CPS 103 also aligns to a genomic sequence between SCGB3A2 and KIAA0555 with at least 97% sequence identity. SCGB3A2 encodes secretoglobin, family 3A, member 2. SCGB3A2 and KIAA0555 are located at chromosome 5q32.

CPS 104 corresponds to PLAUR which encodes plasminogen activator, urokinase receptor. The gene has LocusID: 5329, and is located on chromosome 19 with reported cytogenetic location 19q13. The gene product, urokinase-type plasminogen activator receptor, may function in pericellular plasminogen activation.

CPS 105 corresponds to CDC34 which encodes cell division cycle 34. The gene has LocusID: 997, and is located on chromosome 19 with reported cytogenetic location 19p13.3. The protein encoded by this gene is a member of the ubiquitin conjugating enzyme family. Ubiquitin-conjugating enzyme catalyzes the covalent attachment of ubiquitin to other proteins. CDC34 gene product may be a part of the large multiprotein complex, which is involved in ubiquitin-mediated degradation of cell cycle G1 regulators and the initiation of DNA replication. The gene product is similar to S. cerevisiae Cdc34p, and may covalently attach ubiquitin to substrate proteins.

CPS 106 corresponds to UNK_AI732885 which shows 100% sequence identity with an intron sequence of CG005. CG005 encodes a hypothetical protein from BCRA2 region. CG005 gene has LocusID: 10443, and is located on chromosome 13 with reported cytogenetic location 13q12-q13. The gene product contains a region having low similarity to a region of rat 2',3'-cyclic nucleotide 3'-phosphodiesterase.

CPS 107 corresponds to IL10RA which encodes interleukin 10 receptor, alpha. The gene has LocusID: 3587, and is located on chromosome 11 with reported cytogenetic location 11q23. Nucleotides 3467 to 3496 of U00672 have 100% sequence identity to LOC200074 which is located at chromosome 1p34.3.

CPS 108 corresponds to FBXO7 (FBX7) which encodes F-box only protein 7. The gene has LocusID: 25793, and is located on chromosome 22 with reported cytogenetic location 22q12-q13. This gene encodes a member of the F-box protein family which is characterized by an approximately 40 amino acid motif, the F-box. The F-box proteins constitute one of the four subunits of the ubiquitin protein ligase complex called SCFs (SKP1-cullin-F-box), which functions in phosphorylation-dependent ubiquitination. The F-box proteins are divided into 3 classes: Fbws containing WD-40 domains, Fbls containing leucine-rich repeats, and Fbxs containing either different protein-protein interaction modules or no recognizable motifs. The protein encoded by FBXO7 belongs to the Fbxs class and it may play a role in regulation of hematopoiesis. Alternatively spliced transcript variants of this gene have been reported, but the full length nature of the variants has not been defined.

CPS 109 corresponds to IFIT4 which encodes interferon-induced protein with tetratricopeptide repeats 4. The gene has LocusID: 3437, and is located on chromosome 10 with reported cytogenetic location 10q24.

CPS 110 corresponds to BAX which encodes BCL2-associated X protein. The gene has LocusID: 581, and is located on chromosome 19 with reported cytogenetic location 19q13.3-q13.4. The protein encoded by this gene belongs to the BCL2 protein family. BCL2 family members form hetero- or homodimers and act as anti- or pro-apoptotic regulators that are involved in a wide variety of cellular activities. BAX gene product forms a heterodimer with BCL2, and may function as an apoptotic activator. This gene product is reported to interact with, and increase the opening of, the mitochondrial voltage-dependent anion channel (VDAC), which leads to the loss in membrane potential and the release of cytochrome c. The expression of this gene is regulated by the tumor suppressor P53 and has been shown to be involved in P53-mediated apoptosis. Six alternatively spliced transcript variants, which encode different isoforms, have been reported for this gene. The gene product may induce caspase activation by increasing mitochondrial permeability, and may function in cooperation with the adenine nucleotide translocator (ANT).

CPS 111 corresponds to BSG which encodes basigin (OK blood group). The gene has LocusID: 682, and is located on chromosome 19 with reported cytogenetic location 19p13.3. Basigin (also known as tumor cell-derived collagenase stimulatory factor, extracellular matrix metalloproteinase inducer, M6 antigen) may stimulate matrix metalloproteinase synthesis in fibroblasts. It is a member of the immunoglobulin superfamily.

CPS 111 also aligns to LOC199717 with over 97% sequence identity. LOC199717 encodes a protein similar to basigin. LOC199717 is located on chromosome 19 with reported cytogenetic location 19p13.3.

CPS 112 corresponds to THBS1 which encodes thrombospondin 1. The gene has LocusID: 7057, and is located on chromosome 15 with reported cytogenetic location 15q15. Thrombospondin-1 may have a role in blood clotting and in angiogenesis. It is a member of a family of adhesive molecules.

CPS 113 corresponds to AP1G2 (G2AD) which encodes adaptor-related protein complex 1, gamma 2 subunit. The gene has LocusID: 8906, and is located on chromosome 14 with reported cytogenetic location 14q11.2. Adaptins are important components of clathrin-coated vesicles transporting ligand-receptor complexes from the plasma membrane or from the trans-Golgi network to lysosomes. The adaptin family of proteins is composed of four classes of molecules named alpha, beta-, beta prime- and gamma-adaptins. Adaptins, together with medium and small subunits, form a heterotetrameric complex called an adaptor, whose role may be to promote the formation of clathrin-coated pits and vesicles. The protein encoded by this gene is a gamma-adaptin protein which belongs to the adaptor complexes large subunits family. Gamma-adaptin is thought to function at some trafficking step in the complex pathways between the trans-Golgi network and the cell surface. There are two alternatively spliced transcript variants of this gene encoding the same protein. The gene product can interact with beta-1 adaptin and sigma 1 chain of the AP-1 complex.

CPS 115 corresponds to RALBP1 which encodes ralA binding protein 1. The gene has LocusID: 10928, and is located on chromosome 18 with reported cytogenetic location 18p11.3. RalA binding protein 1 can interact with the activated Ral.

CPS 115 also aligns to KIAA1634 with about 99% sequence identity. KIAA1634 encodes KIAA1634 protein, and is located at chromosome 1p12-p11.2. In addition, CPS 115 shows about 89-92% sequence identity to LOC129522, LOC131054 and a genomic sequence on chromosome 2. LOC129522 encodes a protein similar to ralA binding protein 1, and is located at chromosome 2q11.2. LOC131054 encodes a protein similar to ralA binding protein 1, and is located at chromosome 3q27.2. Nucleotides 3565 to 3875 of L42542 have 94% sequence identity to a chromosome-6 genomic sequence which is located near the polypeptide-coding sequence of LOC221511. LOC221511 encodes MHC class II DP3-alpha, and is located at chromosome 6p21.2.

CPS 116 corresponds to UNK_AF070587 which is located in an intron of the putative gene LOC196932. LOC196932 gene encodes a protein similar to hypothetical protein LOC55580. LOC196932 is located on chromosome 14 with reported cytogenetic location 14q32.12.

Affymetrix annotation suggests that CPS 117 corresponds to DUX1. Blast search against the Entrez human genome database shows that CPS 117 also aligns to LOC200133 and LOC131115 with about 82-86% sequence identity. LOC200133 encodes a protein similar to double homeobox, 4 (double homeobox protein 4). It is located at chromosome 1p31.3. LOC131115 encodes a protein similar to double homeobox protein, and is located at chromosome 3p14.1.

Nucleotides 1 to 698 of SEQ ID NO: 113 (AJ001481) show about 88% sequence identity to DUX4, LOC201498, a genomic sequence near LOC131308, and a genomic sequence near hypothetical gene LOC132684. DUX4 encodes double homeobox, 4. It has LocusID: 22947, and is located on chromosome 4 with reported cytogenetic location 4q35. LOC201498 encodes a protein similar to FSHD Region Gene 2 protein, and is located on chromosome 18. LOC131308 encodes a protein similar to FSHD Region Gene 2 protein, and is located at chromosome 3p14.1. LOC132684 is located at chromosome 4q35.2.

CPS 118 corresponds to SLC6A8 which encodes solute carrier family 6 (neurotransmitter transporter, creatine), member 8. The gene has LocusID: 6535, and is located on chromosome X with reported cytogenetic location Xq28. The gene product is a sodium and chloride-dependent creatine transporter. It is a member of neurotransmitter transporter family.

CPS 118 also has about 95% sequence identity to a genomic region on chromosome 16. This region includes or overlaps genes LOC162151 and LOC146488. LOC146488 encodes a protein similar to disintegrin-like testicular metalloproteinase (EC 3.4.24.-) IVb—crab-eating macaque (fragment). The region has reported cytogenetic location 16p11.1. In addition, CPS 118 has about 95% sequence identity to a genomic sequence which includes or overlaps putative genes LOC204478 and LOC146493. LOC146493 encodes a protein similar to sodium and chloride-dependent creatine transporter 2 (CT2).

Nucleotides 13923 to 14462 of SEQ ID NO: 114 (U36341) have about 94% sequence identity to a chromosomal region which is located 5' to CTAG2 and 3' to GAB3. CTAG2 encodes cancer/testis antigen 2, and has LocusID: 30848. It is located at chromosome Xq28. GAB3 encodes GRB2-associated binding protein 3, and has LocusID: 139716. It is also located at chromosome Xq28.

CPS 119 corresponds to THBD which encodes thrombomodulin. The gene has LocusID: 7056, and is located on chromosome 20 with reported cytogenetic location 20p12-cen. Thrombomodulin can change the procoagulant thrombin into an anticoagulant.

Nucleotides 3867 to 4212 of SEQ ID NO: 115 (J02973) align to a genomic sequence on chromosome 2 with 97% sequence identity. The genomic sequence is located between LOC200422, which encodes a protein similar to somatostatin receptor, and LOC205172. Both LOC200422 and LOC205172 have reported cytogenetic location 2p12.

Blast search against the Entrez human genome database shows that SEQ ID NO: 116 (CPS 120) has about 99% sequence identity to the protein-coding strand of LOC203068 which encodes a protein similar to tubulin, beta 5. LOC203068 is located on chromosome 6. In addition, SEQ ID NO: 116 has at least 99% sequence identity with LOC157586 and LOC157584. LOC157586 and LOC157584 encode proteins similar to hypothetical protein DKFZp564N123.1 (human fragment). Both LOC157586 and LOC157584 are located on chromosome 6. SEQ ID NO: 116 (AF141349) also has 97% sequence identity with the protein-coding strand of LOC92755. LOC92755 is located at chromosome 8p21.1.

Nucleotides 14 to 1586 of SEQ ID NO: 116 have 91% sequence identity to LOC222017 which is located at chromosome 7p14.1. Nucleotides 15 to 1572 of SEQ ID NO: 116 have 87% sequence identity to an intron sequence of SCP2. SCP2 encodes sterol carrier protein 2, and has LocusID: 6342. It is located at chromosome 1p32. Sterol carrier protein 2 may have a role in regulation of steroidogenesis. Moreover, nucleotides 439 to 1474 of SEQ ID NO: 116 share 85% sequence identity to TUBB5 which encodes tubulin, beta, 5. TUBB5 has LocusID: 10382, and is located at chromosome 19p13.3. Beta 5-tubulin can polymerize to form microtubules, and it is a member of a family of structural proteins. Nucleotides 421 to 1444 of SEQ ID NO: 116 also have 84% sequence identity to TUBB4. TUBB4 encodes tubulin, beta, 4, and has LocusID: 10381. It is located at chromosome 16q24.3. Nucleotides 142 to 1474 of SEQ ID NO: 116 align to LOC139112 with 80% sequence identity. LOC139112 encodes a protein similar to tubulin beta, and is located at chromosome Xq25.

CPS 123 corresponds to HBE1 which encodes hemoglobin, epsilon 1. The gene has LocusID: 3046, and is located on chromosome 11 with reported cytogenetic location 11p15.5. The epsilon globin gene (HBE) is expressed in the embryonic yolk sac. Two epsilon chains together with two zeta chains (an alpha-like globin) constitute the embryonic hemoglobin Hb Gower I, and two epsilon chains together with two alpha chains form the embryonic Hb Gower II. Both of these embryonic hemoglobins are normally supplanted by fetal, and later, adult hemoglobin. The five beta-like globin genes are found within a 45 kb cluster on chromosome 11 in the following order: 5'-epsilon—G-gamma—A-gamma—delta—beta-3'. Hemoglobin epsilon 1 (embryonic beta-like) can transport oxygen and carbon dioxide between the lung and tissues, and modulate erythrocyte metabolism and senescence.

CPS 125 corresponds to MAD which encodes MAX dimerization protein. The gene has LocusID: 4084, and is located on chromosome 2 with reported cytogenetic location 2p13-p12. MAX dimerization protein belongs to a subfamily of MAX-interacting proteins. MAD gene product competes with MYC for binding to MAX to form a sequence-specific DNA-binding complex. MAD gene product may act as a transcriptional repressor while MYC appears to function as an activator. MAD gene product is a candidate tumor suppressor gene. The gene product is a basic helix-loop-helix, leucine zipper protein that dimerizes with MAX, and can form a heterodimer with MAX and repress transcription. The gene product may also antagonize c-Myc (MYC) and promote cellular differentiation.

CPS 126 corresponds to TSPAN-5 which encodes tetraspan 5. The gene has LocusID: 10098, and is located on chromosome 4 with reported cytogenetic location 4q23. The protein encoded by this gene is a member of the transmembrane 4 superfamily, also known as the tetraspanin family. A lot of members in the superfamily are cell-surface proteins that are characterized by the presence of four hydrophobic domains. These proteins may mediate signal transduction events involved in the regulation of cell development, activation, growth and motility.

CPS 127 corresponds to BAG1 which encodes BCL2-associated athanogene. The gene has LocusID: 573, and is located on chromosome 9 with reported cytogenetic location 9p12. The oncogene BCL2 is a membrane protein that blocks a step in a pathway leading to apoptosis or programmed cell death. The BAG1 protein binds to BCL2 and is referred to as BCL2-associated athanogene. BAG1 enhances the anti-apoptotic effects of BCL2 and represents a link between growth factor receptors and anti-apoptotic mechanisms. BAG1 interacts with both the hepatocyte growth factor receptor and the platelet-derived growth factor receptor and, in both cases, enhances growth factor-mediated protection from apoptosis. At least three proteins, BAG1L, BAG-1M and BAG-1, are encoded by the BAG-1 mRNA through the use of alternative translation initiation sites.

Nucleotides 454 to 1006 of SEQ ID NO: 120 (Z35491) have 88% sequence identity to a chromosomal region on chromosome X. In addition, nucleotides 517 to 646 of SEQ ID NO: 120 align to LOC205900 with 100% sequence identity. LOC205900 encodes a protein similar to serine protease inhibitor Kazaltype 4 precursor (Peptide PEC-60 homolog). LOC205900 is located on chromosome 4.

CPS 128 corresponds to PADI2 (PDI2) which encodes peptidyl arginine deiminase, type II. The gene has LocusID: 11240, and is located on chromosome 0.1 with reported cytogenetic location 1p35.2-p35.1. The gene product is similar to rat skeletal muscle peptidyl arginine deiminase, type II, and may convert arginine residues within proteins to citrulline residues.

Nucleotides 3315 to 4119 of SEQ ID NO: 121 (AB023211) align with PRKG1 with 79% sequence identity. PRKG1 encodes protein kinase, cGMP-dependent, type I, and has LocusID: 5592. Type I cGMP-dependent protein kinase may relax vascular smooth muscle and inhibit platelet aggregation. The gene is located at chromosome 10q11.2. Nucleotides 1375 to 1500 of SEQ ID NO: 121 have 85% sequence identity with PADI1 which encodes peptidyl arginine deiminase, type I. PADI1 has LocusID: 29943, and is located on chromosome 1 with reported cytogenetic location 1p36.13.

CPS 129 corresponds to IL1R1 which encodes interleukin 1 receptor, type I. The gene has LocusID: 3554, and is located on chromosome 2 with reported cytogenetic location 2q12. Type I interleukin-1 receptor can bind all three forms of interleukin-1 (IL1A, IL1B, and IL1RN). The protein contains immunoglobulin domains.

CPS 130 corresponds to NP which encodes nucleoside phosphorylase. The gene has LocusID: 4860, and is located on chromosome 14 with reported cytogenetic location 14q13.1. NP encodes the enzyme purine nucleoside phosphorylase. The encoded protein, together with adenosine deaminase (ADA), serves a key role in purine catabolism, which is referred to as the salvage pathway. Mutations in the encoded protein may result in a severe combined immunodeficiency (SCID).

CPS 131 corresponds to the 3' untranslated region of AQP3 which encodes aquaporin 3. The gene has LocusID: 360, and is located on chromosome 9 with reported cytogenetic location 9p13. CPS 131 is located in the 3' untranslated region of AQP3. Aquaporin 3 is a water channel protein. Aquaporins are a family of small integral membrane proteins related to the major intrinsic protein (MIP or AQP0). Aquaporin 3 is localized at the basal lateral membranes of collecting duct cells in the kidney. In addition to its water channel function, aquaporin 3 has been found to facilitate the transport of nonionic small solutes such as urea and glycerol, but to a smaller degree. It has been suggested that water channels can be functionally heterogeneous and possess water and solute permeation mechanisms.

CPS 132 corresponds to GSPT1 which encodes G1 to S phase transition 1. The gene has LocusID: 2935, and is located on chromosome 16 with reported cytogenetic location 16p13.1. The gene product is a GTP-binding protein, and has GTP-binding activity. The product is similar to polypeptide chain elongation factor EFI alpha (EEF1A1) and may have a role in G1 to S phase transition.

CPS 132 has about 85% sequence identity with LOC120337. LOC120337 encodes a protein similar to G1 to S phase transition protein 1 homolog (GTP-binding protein GST1-HS). LOC120337 is located at chromosome 11q22.3. Nucleotides 2301 to 2587 of X17644 align with a genomics sequence located 5' to GNB2 with sequence identity of 83%. GNB2 encodes guanine nucleotide binding protein (G protein), beta polypeptide 2. GNB2 has LocusID: 2783, and is located on chromosome 7 with reported cytogenetic location 7q22. Nucleotides 291 to 576 and 585 to 2494 of SEQ ID NO: 125 (X17644) have 82-87% sequence identity with GSPT2 which encodes G1 to S phase transition 2. GSPT2 has LocusID: 23708, and is located on chromosome 5. Nucleotides 2522 to 2587 of SEQ ID NO: 125 have 93% sequence identity with an intron sequence of LOC153643. LOC153643 encodes a protein similar to hypothetical protein FLJ14957, and is located at chromosome 5q21.1.

CPS 133 corresponds to GABARAPL2 (GEF-2) which encodes GABA(A) receptor-associated protein-like 2. The gene has LocusID: 11345, and is located on chromosome 16 with reported cytogenetic location 16q22.3-q24.1. The gene product is a phosphoprotein and contains putative actin and nucleotide binding sites. The alternative names for the gene product include GEF2 or ganglioside expression factor 2.

CPS 133 also has about 81-82% sequence identity with a genomic sequence located 3' to LOC206774, and an intron sequence of RAB3-GAP150. LOC206774 is located at chromosome 8q24.12. RAB3-GAP150 encodes the non-catalytic subunit (150 kD) of the rab3 GTPase-activating protein. RAB3-GAP150 has LocusID: 25782, and is located at chromosome 1q42.12. Nucleotides 26 to 253 of SEQ ID NO: 126 (AI565760) have about 84% sequence identity with an intron sequence of ACCN1. ACCN1 encodes amiloride-sensitive cation channel 1, neuronal (degenerin). ACCN1 has LocusID: 40, and is located at chromosome 17q11.2-q12.

CPS 134 corresponds to HBD which encodes hemoglobin, delta. The gene is located on chromosome 11 with reported cytogenetic location 11p15.5. The gene has LocusID: 3043. HBB, which encodes hemoglobin, beta, is also located in this chromosomal region. The alpha (HBA) and beta (HBB) loci determine the structure of the 2 types of polypeptide chains in adult hemoglobin, Hb A. The normal adult hemoglobin tetramer consists of two alpha chains and two beta chains. Mutant beta globin causes sickle cell anemia. Absence of beta chain causes beta-zero-thalassemia. Reduced amounts of detectable beta globin causes beta-plus-thalassemia. The order of the genes in the beta-globin cluster is 5'-epsilon—gamma-G—gamma-A—delta—beta-3'.

A fragment of CPS 134 (nucleotides 2 to 366 of SEQ ID NO: 127) aligns to HBB with 93-96% sequence identity. Moreover, another fragment of CPS 134 (nucleotides 157 to 364 of SEQ ID NO: 127) has 80% sequence identity with HBE1. HBE1 encodes hemoglobin, epsilon 1. It has LocusID: 3046, and is located at chromosome 11p15.5.

CPS 135 corresponds to HAGH which encodes hydroxyacyl glutathione hydrolase. The gene has LocusID: 3029, and is located on chromosome 16 with reported cytogenetic location 16p13.3. The enzyme encoded by this gene is classified as a thiolesterase and is responsible for the hydrolysis of S-lactoyl-glutathione to reduced glutathione and D-lactate.

CPS 136 corresponds to ERN1 which encodes ER to nucleus signalling 1. The gene has LocusID: 2081, and is located on chromosome 17. The gene product is a human homolog of the yeast Ire1 gene product. The ERN1 protein is important in altering gene expression as a response to endoplasmic reticulum based stress signals. The ERN1 protein is a transmembrane endoplasmic reticulum protein, and may act as a sensor of the unfolded protein response pathway.

Nucleotides 1504 to 1536 of SEQ ID NO: 129 (AF059198) have 96% sequence identity with a chromosomal region on chromosome 3. The region is near LOC152282 which encodes a protein similar to homeobox protein goosecoid. LOC15228 is located at chromosome 3p25.1.

CPS 137 corresponds to COL9A1 which encodes collagen, type IX, alpha 1. The gene has LocusID: 1297, and is located on chromosome 6 with reported cytogenetic location 6q12-q14. This gene encodes one of the three alpha chains of type IX collagen, a major collagen component of hyaline cartilage. Type IX collagen is usually found in tissues containing type II collagen, a fibrillar collagen. Studies in knockout mice have shown that synthesis of the alpha 1 chain is essential for assembly of type IX collagen molecules, a heterotrimeric molecule, and that lack of type IX collagen is associated with early onset osteoarthritis. Mutations in this gene may be associated with multiple epiphyseal dysplasia. Two transcript variants have been identified for this gene.

CPS 138 corresponds to S100A11 which encodes S100 calcium binding protein A11 (calgizzarin). The gene has LocusID: 6282, and is located on chromosome 1 with reported cytogenetic location 1q21. The protein encoded by this gene is a member of the S100 family of proteins containing 2 EF-hand calcium-binding motifs. S100 proteins are localized in the cytoplasm and/or nucleus of a wide range of cells, and may be involved in the regulation of a number of cellular processes such as cell cycle progression and differentiation. S100 genes include at least 13 members which are located as a cluster on chromosome 1q21. S100A11 gene product may function in motility, invasion, and tubulin polymerization. Chromosomal rearrangements and altered expression of S100A11 have been implicated in tumor metastasis. Alternative splicing of the 5' UTR of S100A11 results in two gene products.

CPS 138 also has about 88-90% sequence identity with S100A14, LOC222128, LOC202763 and a genomic sequence containing LOC221948. S100A14 encodes S100 calcium binding protein A14 (calgizzarin). S100A14 has LocusID: 30013, and is located at chromosome 7q22-q31.1. S100A14 gene product is similar to human calgranulin C protein, and may belong to S100 protein family. LOC222128 encodes protein dpy-19, and is located at chromosome 7p15.3. LOC221948 encodes calgizzarin (S100C protein) (MLN 70), and is located at chromosome 7p22.3. LOC202763 encodes a protein similar to protein dpy-19, and is located on chromosome 17. Nucleotides 103 to 149 of SEQ ID NO: 131 (D38583) align with a genomic sequence on chromosome X with over 90% sequence identity.

CPS 139 corresponds to FKBP1B which encodes FK506 binding protein 1B (12.6 kD). The gene has LocusID: 2281, and is located on chromosome 2 with reported cytogenetic location 2p23.3. The protein encoded by this gene is a member of the immunophilin protein family. This family of proteins may play a role in immunoregulation and basic cellular processes involving protein folding and trafficking. FKBP1B gene product is a cis-trans prolyl isomerase that can bind the immunosuppressants FK506 and rapamycin. It is similar to the FK506-binding protein 1A. Its physiological role is thought to be in the excitation-contraction coupling in cardiac muscle. There are at least two alternatively spliced transcript variants of this gene encoding different isoforms.

CPS 139 also has about 83% sequence identity with an intron sequence of LOC145581. LOC145581 encodes a protein similar to hypothetical protein MGC2656, and is located at chromosome 14q13.3.

CPS 141 corresponds to RNAH which encodes RNA helicase family. The gene has LocusID: 10973, and is located on chromosome 6 with reported cytogenetic location 6q16. CPS 141 is located in the 3' untranslated region of the gene.

CPS 142 corresponds to MYL9 (MYRL2) which encodes myosin, light polypeptide 9, regulatory. The gene has LocusID: 10398, and is located on chromosome 20 with reported cytogenetic location 20q11.22. The gene product is also known as myosin regulatory light chain 2. The gene product may regulate ATPase activity of myosin heads, and is a member of a protein family that regulates myosin activity.

CPS 143 corresponds to SPOP which encodes speckle-type POZ protein. The gene has LocusID: 8405, and is located on chromosome 17 with reported cytogenetic location 17q22. The gene product is an autoantigenic protein and may be a DNA or actin binding protein. The product contains a POZ domain, and may mediate protein-protein interactions.

CPS 144 corresponds to the 3' untranslated region of SLC11A1 which encodes solute carrier family 11 (proton-coupled divalent metal ion transporters), member 1. The gene has LocusID: 6556, and is located on chromosome 2 with reported cytogenetic location 2q35. The gene product is similar to murine Bcg (Nramp1), and may control antimicrobial activity of macrophages.

CPS 145 corresponds to SIAH2 which encodes seven in absentia homolog 2 (Drosophila). The gene has LocusID: 6478, and is located on chromosome 3 with reported cytogenetic location 3q25. The gene product may be a negative regulator of Vav and DCC mediated signaling pathways.

CPS 146 corresponds to S100P which encodes S100 calcium binding protein P. The gene has LocusID: 6286, and is located on chromosome 4 with reported cytogenetic location 4p16. The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21. However, S100P is located at chromosome 4p16. S1OOP protein, in addition to binding Ca2+, also binds Zn2+ and Mg2+. This protein may play a role in the etiology of prostate cancer.

CPS 147 corresponds to TNNT1 which encodes troponin T1, skeletal, slow. The gene has LocusID: 7138, and is located on chromosome 19 with reported cytogenetic location 19q13.4. The gene product is also known as troponin T1, tropomyosin-binding subunit of troponin, or slow twitch skeletal muscle regulatory protein.

Nucleotides 15639 to 15571 of SEQ ID NO: 139 (AJ011712) have 84% sequence identity with a chromosomal region at 4q32.3. Nucleotides 15562 to 15604 of SEQ ID NO: 139 have 93% sequence identity with a chromosomal region near TRAF6. TRAF6 encodes TNF receptor-associated factor 6, and has LocusID: 7189. TRAF6 is located at chromosome 11p11.2.

CPS 148 corresponds to KIAA0750 which encodes KIAA0750 gene product. The gene has LocusID: 9645, and is located on chromosome 11 with reported cytogenetic location 11p15.2.

CPS 149 corresponds to FOS which encodes v-fos FBJ murine osteosarcoma viral oncogene homolog. The gene has LocusID: 2353, and is located on chromosome 14 with reported cytogenetic location 14q24.3. The Fos gene family consists of at least four members: FOS, FOSB, FOSL1, and FOSL2. These genes encode leucine zipper proteins that can dimerize with proteins of the JUN family, thereby forming the transcription factor complex AP-1. As such, the FOS proteins have been implicated as regulators of cell proliferation, differentiation, and transformation. In some cases, expression of the FOS gene has been associated with apoptotic cell death. FOS gene product may function as a transcription factor. It may also be involved in regulation of DNA methylation. The chromosomal region that aligns with CPS 149 also contains LOC196923. LOC196923 encodes a protein similar to proto-oncogene protein c-fos (cellular oncogene fos) (G0/G1 switch regulatory protein 7).

Nucleotides 1 to 6210 of SEQ ID NO: 141 (K00650) also align with a chromosomal region on chromosome 14 with. 99% sequence identity. This chromosomal region includes LOC196937, LOC196936 and LOC196935. All of these three putative genes have reported cytogenetic location 14q23.2. LOC196936 encodes a protein similar to proto-oncogene protein c-fos (cellular oncogene fos) (G0/G1 switch regulatory protein 7). LOC196935 encodes a protein similar to proto-oncogene protein c-fos (cellular oncogene fos) (G0/G1 switch regulatory protein 7).

CPS 150 corresponds to SERPINB2 (PAI2) which encodes serine (or cysteine) proteinase inhibitor, clade B (ovalbumin), member 2. The gene has LocusID: 5055, and is located on chromosome 18 with reported cytogenetic location 18q21.3. The gene product is known as plasminogen activator inhibitor, type II (arginine-serpin). It is a member of the serpin family of serine protease inhibitors. Alternative names for this gene product include PAI or PLANH2.

CPS 151 corresponds to PDXK which encodes pyridoxal (pyridoxine, vitamin B6) kinase. The gene has LocusID: 8566, and is located on chromosome 21 with reported cytogenetic location 21q22.3.

CPS 152 can be derived from *homo sapiens* mRNA or cDNA DKFZp564D113 (from clone DKFZp564D113). CPS 152 corresponds to a hypothetic gene UNK_AL049250 which represents gene or genes that produce the RNA transcripts capable of hybridizing under stringent conditions to CPS 152. CPS 152 aligns to various chromosomal regions with 97-98% sequence identity. One region includes LOC1196123 which is located in an intron sequence of LOC143518. LOC143518 is located on chromosome 11. Another region is located at chromosome 16p12.1 and includes or overlaps LOC146384, LOC197204, and LOC146136. LOC146136 encodes a protein similar to nuclear pore complex interacting protein. A third region is also located at chromosome 16p12.1, and overlaps LOC220548 which encodes hypothetical protein KIAA0220. A fourth region is next to KIAA0220 which encodes KIAA0220 protein and is located at chromosome 16p12.1. A fifth region is at 16p12.2, and next to LOC146172. A sixth region is on chromosome 7 and includes or overlaps LOC202736, LOC154729, and LOC154725. LOC154729 encodes a protein similar to nuclear pore complex interacting protein. LOC154725 encodes a protein similar to hypothetical protein KIAA0220. A seventh region is near LOC146385 which is located at chromosome 16q13. An eighth region includes LOC197445 which is also located at chromosome 16q13 and encodes a protein similar to BTG3 associated nuclear protein, isoform a (BANP homolog or SMAR1 homolog). A ninth region is at 16q22.3 and includes LOC146452 which encodes a protein similar to KIAA0251 hypothetical protein. A tenth region is at 16p13.2, and aligns with putative gene LOC146613. An eleventh region is located 5' to the polypeptide-coding sequence of NPIP. NPIP encodes a nuclear pore complex interacting protein, and has LocusID: 9284. NPIP is located at chromosome 16p13-p11. Yet another region is located near LOC124155. LOC124155 encodes a protein similar to nuclear pore complex interacting protein, and is located at chromosome 16p11.2. Other regions include LOC197366 at 16p11.2, KIAA0370 at 16p12.1-p11.2, LOC146130 at 16p11.1, and LOC197362 at 16p11.2.

In addition, CPS 152 has about 97% sequence identity with BANP. BANP encodes BTG3 associated nuclear protein, and has LocusID: 54971. The gene is located at chromosome 18. BTG3 is a protein that interacts with CAF1 which is a component of the general transcription multisubunit complex. It is thought that BTG3 is involved in negative control of the cell cycle. The protein encoded by BANP can bind to BTG3. Studies with mouse homolog suggest that this encoded protein may also interact with a specific nuclear matrix/scaffold-associated region (MAR). Transcript variants encoding different isoforms have been described for BANP gene.

CPS 152 also aligns with LOC118735 with about 92% sequence identity. LOC118735 encodes a protein similar to apoptosis response protein or prostate apoptosis response protein 4. This gene is located on chromosome 10 with reported cytogenetic location 10q24.2.

Furthermore, fragments of AL049250 (SEQ ID NO: 144) align with other chromosomal regions with about 78-85% sequence identity. For instance, nucleotides 182 to 2011 of AL049250 align with a genomic sequence near LOC139011. LOC139011 encodes a protein similar to *Arabidopsis thaliana* DNA-directed RNA polymerase (EC 2.7.7.6) II largest chain (JDMU1). LOC139011 is located at chromosome 1p15.5. Nucleotides 1720 to 2185 of SEQ ID NO: 144 (AL049250) align with LOC220178 which has sequence similarity to rat kidney-specific (KS) gene and is located at chromosome 10q23.2. Nucleotides 1463 to 1911 of SEQ ID NO: 144 align with CECR7 which encodes cat eye syndrome chromosome region, candidate 7. CECR7 has LocusID: 27438, and is located on chromosome 22. Moreover, nucleotides 1483 to 1943 of SEQ ID NO: 144 align with LOC204354 which encodes a protein similar to SA rat hypertension-associated homolog and is located on chromosome 15. Nucleotides 1483 to 1943 of SEQ ID NO: 144 align with BUCS1 which encodes butyryl Coenzyme A synthetase 1. BUCS1 has LocusID: 116285, and is located on chromosome 16 with reported cytogenetic location 16p12.2.

CPS 153 corresponds to GRO2 which encodes GRO2 oncogene. The gene has LocusID: 2920, and is located on chromosome 4 with reported cytogenetic location 4q21. The gene product may be a chemotactic agent for polymorphonuclear leukocytes.

CPS 153 also aligns with GRO1 with about 85% sequence identity. GRO1 represents GRO1 oncogene (melanoma growth stimulating activity, alpha). The gene has LocusID: 2919, and is located on chromosome 4. The gene product has melanoma growth stimulating activity, and may be a mitogenic factor involved in inflammatory processes.

In addition, nucleotides 2 to 298 of M36820 (SEQ ID NO: 145) have about 89-94% sequence identity with GRO3. GRO3 represents GRO3 oncogene, and has LocusID: 2921. The gene is located at chromosome 4q21. GRO3 gene product may be a mitogenic factor. Nucleotides 184-299 of SEQ ID NO: 145 (M36820) have 91% sequence identity with LOC201963. LOC201963 encodes a protein similar to heterogeneous nuclear ribonucleoprotein A1 (helix-destabilizing protein) (single-strand binding protein) (hnRNP core protein A1) (HDP). LOC201963 is located at chromosome 4q13.3.

CPS 154 corresponds to INPP4A which encodes inositol polyphosphate-4-phosphatase, type I, 107 kD. The gene has LocusID: 3631, and is located on chromosome 2 with reported cytogenetic location 2q11.2. INPP4A gene product involves in phosphatidylinositol signaling pathways. This product removes the phosphate group at position 4 of the inositol ring from inositol 3,4-bisphosphate.

CPS 155 corresponds to GPT which encodes glutamic-pyruvate transaminase (alanine aminotransferase). The gene has LocusID: 2875, and is located on chromosome 8 with reported cytogenetic location 8q24.3.

Nucleotides 9 to 1550 of SEQ ID NO: 147 (U70732) align with a chromosomal region with 96% sequence identity. The chromosomal region is located 3' to FBXL6. FBXL6 encodes F-box and leucine-rich repeat protein 6, and has LocusID: 26233. FBXL6 is located at chromosome 8q24.3. FBXL6 encodes a member of the F-box protein family which is characterized by an approximately 40 amino acid motif, the F-box. Nucleotides 1962 to 2110 of SEQ ID NO: 147 have 83% sequence identity with GPT2 which encodes glutamic pyruvate transaminase (alanine aminotransferase) 2. GPT2 has LocusID: 84706, and is located on chromosome 16.

CPS 156 corresponds to MYL4 which encodes myosin, light polypeptide 4, alkali; atrial, embryonic. The gene has LocusID: 4635, and is located on chromosome 17 with reported cytogenetic location 17q21-qter. Myosin is a hexameric ATPase cellular motor protein. It is composed of two myosin heavy chains, two nonphosphorylatable myosin alkali light chains, and two phosphorylatable myosin regulatory light chains. MYL4 encodes a myosin alkali light chain that is found in embryonic muscle and adult atria. MYL4 gene product may modulate the interaction between myosin and actin. It is a member of a family of mysosin and actin regulatory proteins CPS 157 corresponds to NFE2 which encodes nuclear factor (erythroid-derived 2), 45 kD. The gene has LocusID: 4778, and is located on chromosome 12 with reported cytogenetic location 12q13. NFE2 gene product is a 45 kD subunit of the bZIP dimeric transcription factor. The transcription factor may regulate expression of the beta globin gene (HBB). CPS 157, as well as NFE2, are located within an intron of ATF7. ATF7 encodes activating transcription factor 7, and has LocusID: 11016. ATF7 is located at chromosome 12q13. The gene product is a leucine zipper DNA-binding protein, and may recognize a cAMP response element (CRE). The gene product may also be involved in the regulation of adenovirus E1a-responsive and cellular cAMP-inducible promoters.

CPS 158 corresponds to POLR2J which encodes polymerase (RNA) II (DNA directed) polypeptide J (13.3 kD). The gene has LocusID: 5439, and is located on chromosome 7 with reported cytogenetic location 7q11.2. This gene encodes a subunit of RNA polymerase II, the polymerase responsible for synthesizing messenger RNA in eukaryotes. The product of this gene exists as a heterodimer with another polymerase subunit, and the heterodimer forms a core subassembly unit of the polymerase. Two similar genes are located nearby at chromosome 7q11.2 and another similar locus is found at chromosome 7p15.

Nucleotides 11 to 382 of SEQ ID NO: 150 (L37127) have 94% sequence identity with LOC245815. LOC245815, also known as POLR2J2, is a DNA directed RNA polymerase II polypeptide J-related gene. LOC245815 has LocusID: 246721, and is located at chromosome 7q11.22. Similarity to a related locus suggests that LOC245815 encodes a subunit of RNA polymerase II. Alternative splicing of this gene results in at least three transcript variants encoding different isoforms.

In addition, nucleotides 11 to 382 of L37127 have 94% sequence identity with a chromosomal region near LOC154696 and a chromosomal region on chromosome 7. LOC154696 encodes a protein similar to HSPC047 protein, and is located at chromosome 7p15.1.

CPS 159 corresponds to CARM1 which encodes coactivator-associated arginine methyltransferase-1. The gene has LocusID: 10498, and is located on chromosome 19 with reported cytogenetic location 19p13.2.

CPS 160 corresponds to UNK_AF038171 which is located in an intron sequence of LOC206073. LOC206073 is located on chromosome 4 with reported cytogenetic location 4q24.

CPS 161 corresponds to RAB2 which encodes RAB2, member RAS oncogene family. The gene has LocusID: 5862, and is located on chromosome 8 with reported cytogenetic location 8q11.23. RAB2 gene product is also known as GTP-binding protein 2, and may be involved in vesicle transport from the ER to the Golgi complex. The gene product is a member of the RAB-subfamily.

Affymetrix annotation suggests that CPS 162 corresponds to 6H9A. Blast search against the Entrez human genome database shows that CPS 162 aligns with an intron sequence of MYO1E with about 94% sequence identity. MYO1E encodes myosin IE, and has LocusID: 4643. MYO1E is located on chromosome 15 with reported cytogenetic location 15q21-q22. MYOO1E gene product is similar to class I myosin, and may bind to proline-rich peptides. The gene product contains an Src homology 3 (SH3) and a myosin head domain (motor domain).

CPS 163 corresponds to EPB42 which encodes erythrocyte membrane protein band 4.2. The gene has LocusID: 2038, and is located on chromosome 15 with reported cytogenetic location 15q15-q21. Erythrocyte membrane protein band 4.2 is an ATP-binding protein which may regulate the association of protein 3 with ankyrin. It probably has a role in erythrocyte shape and mechanical property regulation. Mutations in the EPB42 gene are associated with recessive spherocytic elliptocytosis and recessively transmitted hereditary hemolytic anemia.

CPS 163 also aligns with LOC203401 with about 97% sequence identity. LOC203401 encodes a protein similar to erythrocyte membrane protein band 4.2 (P4.2) (Pallidin). The chromosomal location of LOC203401 is unknown.

CPS 164 corresponds to CGTHBA which denotes "conserved gene telomeric to alpha globin cluster." The gene has LocusID: 8131, and is located on chromosome 16 with reported cytogenetic location 16p13.3.

CPS 165 corresponds to DOC-1R which encodes tumor suppressor deleted in oral cancer-related 1. The gene has LocusID: 10263, and is located on chromosome 11 with reported cytogenetic location 11q13. The gene product is similar to hamster doo-1. CPS 165 also aligns with LOC222984 with about 89% sequence identity. LOC222984 encodes a protein similar to tumor suppressor deleted in oral cancer-related 1, and is located at chromosome 7p22.2.

Nucleotides 3 to 663 of SEQ ID NO: 157 (AF089814) have about 86% sequence identity with LOC169609 and LOC169607. Both genes encode a protein similar to Myosin Vb (Myosin 5B). LOC169609 is located at chromosome 9q12. LOC169607 is located at chromosome 9q21.11. In addition, nucleotides 3 to 777 of AF089814 have about 86-93% sequence identity with LOC138403. LOC138403 encodes a protein similar to Myosin Vb (Myosin 5B), and is located at chromosome 9q13.

CPS 166 corresponds to KIAA0353 (DMN) which encodes desmuslin. The gene has LocusID: 23336. DMN is located on chromosome 15 with reported cytogenetic location 15q26.3.

A fragment of CPS 166 (nucleotides 477 to 602 of AI077476) aligns with LOC120511 with about 97% sequence identity. LOC120511 encodes a protein similar to rig-1 protein (mouse), and is located at chromosome 11q23.3.

Affymetrix annotation suggests that CPS 167 corresponds to CSH1. Blast search against the Entrez human genome database shows that CPS 167 also aligns with CSH2 with about 98% sequence identity. CSH2 encodes chorionic somatomammotropin hormone 2. The gene has LocusID: 1443, and is located on chromosome 17 with reported cytogenetic location 17q24.2. The protein encoded by this gene is a member of the somatotropin/prolactin family of hormones and may play an important role in growth control. CSH2 is located at the growth hormone locus on chromosome 17 along with four other related genes in the same transcriptional orientation. This arrangement is thought to have evolved by a series of gene duplications. Although the five genes share a high degree of sequence identity, they are reported to be expressed in different tissues. Alternative splicing generates additional isoforms of each of the five growth hormones. CSH2 is expressed in the placenta and utilizes multiple transcription initiation sites. Expression of the mature proteins for chorionic somatomammotropin hormones 1 and 2 is upregulated during development.

CPS 168 corresponds to LOC51048 (DKK3) which encodes dickkopf homolog 3 (*Xenopus laevis*) (RIG-like 5-6). The gene has LocusID: 27122, and is located on chromosome 11 with reported cytogenetic location 11p15.2. DKK3 gene product is also known as RIG-like 7-1, and may be related to proteins that antagonize Wnt signaling.

Nucleotides 3 to 92 of SEQ ID NO: 160 (AF034209) have about 90% sequence identity with RIG (regulated in glioma). RIG has LocusID: 10530, and is located at chromosome 11p15.1.

CPS 169 corresponds to SELP which encodes selectin P (granule membrane protein 140 kD, antigen CD62). The gene has LocusID: 6403, and is located on chromosome 1 with reported cytogenetic location 1q22-q25. SELP gene product is a platelet alpha-granule membrane protein of molecular weight 140,000 that redistributes to the plasma membrane during platelet activation and degranulation. It is a member of a family of adhesion/homing receptors. Alternative splice variants may occur but are not well documented. The gene product may mediate interactions of leukocytes with the blood vessel wall. It contains an EGF domain and complement regulatory (CR) protein domains.

CPS 170 corresponds to RAP1GA1 which encodes GTPase activating protein 1 for RAP1. The gene has LocusID: 5909, and is located on chromosome 1 with reported cytogenetic location 1p36.1-p35. Nucleotides 916 to 1044 of SEQ ID NO: 162 (M64788) have about 85% identity with KIAA1039. KIAA1039 encodes KIAA1039 protein, and has LocusID: 23108. The gene has reported cytogenetic location 17p13.3.

CPS 171 corresponds to THBS1 which encodes thrombospondin 1. The gene has LocusID: 7057, and is located on chromosome 15 with reported cytogenetic location 15q15. Thrombospondin-1 may have a role in blood clotting and in angiogenesis. It is a member of a family of adhesive molecules.

CPS 172 corresponds to CHRNA4 which encodes cholinergic receptor, nicotinic, alpha polypeptide 4. The gene has LocusID: 1137, and is located on chromosome 20 with reported cytogenetic location 20q13.2-q13.3. Nucleotides 615 to 1995 of SEQ ID NO: 164 (U62433) also align with LOC149656. LOC149656 encodes a protein similar to neuronal acetylcholine receptor protein, alpha-4 chain precursor, and is located at chromosome 20q13.33.

Fragments of nucleotides 602 to 1313 of U62433 (SEQ ID NO: 164) align with CHRNA2, CHRNA3 and CHRNB2 with about 79-89% sequence identity. CHRNA2 encodes cholinergic receptor, nicotinic, alpha polypeptide 2 (neuronal). CHRNA2 has LocusID: 1135, and is located at chromosome 8p21. CHRNA3 encodes cholinergic receptor, nicotinic, alpha polypeptide 3. CHRNA3 has LocusID: 1136, and is located at chromosome 15q24. CHRNB2 encodes cholinergic receptor, nicotinic, beta polypeptide 2 (neuronal). CHRNB2 has LocusID: 1141, and is located at chromosome 1q21.3.

CPS 173 corresponds to S100A12 which encodes S100 calcium binding protein A12 (calgranulin C). The gene has LocusID: 6283, and is located on chromosome 1 with reported cytogenetic location 1q21. The protein encoded by this gene is a member of the S100 family of proteins containing 2 EF-hand calcium-binding motifs. S100 proteins are localized in the cytoplasm and/or nucleus of a wide range of cells, and involved in the regulation of a number of cellular processes such as cell cycle progression and differentiation. S100 genes include at least 13 members which are located as a cluster on chromosome 1q21. S100A12 gene product is proposed to be involved in specific calcium-dependent signal transduction pathways, and its regulatory effect on cytoskeletal components may modulate various neutrophil activities.

CPS 174 corresponds to CD9 which encodes CD9 antigen (p24). The gene has LocusID: 928, and is located on chromosome 12 with reported cytogenetic location 12p13.3. The protein encoded by this gene is a member of the transmembrane 4 superfamily, also known as the tetraspanin family. Most of these members are cell-surface proteins that are characterized by the presence of four hydrophobic domains. These proteins mediate signal transduction events that play a role in the regulation of cell development, activation, growth and motility. CD9-encoded protein is a cell surface glycoprotein that is known to complex with integrins and other transmembrane 4 superfamily proteins. It can modulate cell adhesion and migration and also trigger platelet activation and aggregation. In addition, the encoded protein appears to promote muscle cell fusion and support myotube maintenance.

CPS 175 corresponds to PRDX2 (TDPX1) which encodes peroxiredoxin 2. Peroxiredoxin 2 is also known as thioredoxin-dependent peroxide reductase (thiol-specific antioxidant 1, natural killer-enhancing factor B), and may be protective against oxidative stress. PRDX2 gene has LocusID: 7001, and is located on chromosome 19 with reported cytogenetic location 19p13.2.

CPS 175 has about 88% sequence identity with MGC2599 and LOC134602. MGC2599 encodes hypothetical protein MGC2599 which is similar to katanin p60 subunit A 1 2599. The gene has LocusID: 84056, and is located at chromosome 13q12.2. LOC134602 encodes a protein similar to thiol-specific antioxidant (TSA), and is located at chromosome 6q21.

Nucleotides 497 to 767 of SEQ ID NO: 167 (L19185) align with LOC219772 with 89% sequence identity. LOC219772 encodes peroxiredoxin 2 (thioredoxin peroxidase 1) (thioredoxin-dependent peroxide reductase 1) (thiol-specific antioxidant protein) (TSA) (PRP) (Natural killer cell enhancing factor B) (NKEF-B). LOC219772 is located at chromosome 10q10.21. Moreover, nucleotides 5 to 65 of L19185 show 100% sequence identity with LOC204141 and LOC205227. LOC204141 is similar to H-NUC (human), and is located on chromosome 13. LOC205227 encodes a protein similar to malonyl-CoA decarboxylase (EC 4.1.1.9) (goose), and is located on chromosome 2.

CPS 176 corresponds to B7 which encodes B7 protein. The gene has LocusID: 10233, and is located on chromosome 12 with reported cytogenetic location 12p13. B7 protein has a low sequence similarity to the regulatory subunit of protein phosphatases. B7 protein contains leucine rich repeats, and may mediate protein-protein interactions.

CPS 177 corresponds to BPGM which encodes 2,3-bisphosphoglycerate mutase. The gene has LocusID: 669, and is located on chromosome 7 with reported cytogenetic location 7q31-q34. 2,3-bisphosphoglycerate mutase has synthase, mutase, and phosphatase activities. It is involved in controlling 2,3-diphosphoglycerate metabolism.

CPS 178 corresponds to PSMA7 which encodes proteasome (prosome, macropain) subunit, alpha type, 7. The gene has LocusID: 5688, and is located on chromosome 20 with reported cytogenetic location 20q13.33. Alpha subunit 7 of the proteasome (prosome macropain) is a possible target for hepatitis B virus X protein.

CPS 179 corresponds to GMPR which encodes guanosine monophosphate reductase. The gene has LocusID: 2766, and is located on chromosome 6 with reported cytogenetic location 6p23. Guanosine monophosphate reductase may facilitate thermogenesis, and has very strong similarity to rat guanosine monophosphate reductase.

CPS 180 corresponds to TMOD which encodes tropomodulin. The gene has LocusID: 7111, and is located on chromosome 9 with reported cytogenetic location 9q22.3. Tropomodulin can bind to an end of erythrocyte tropomyosin.

CPS 181 corresponds to C4A which encodes complement component 4A. The gene has LocusID: 720. The gene is located on chromosome 6. This gene encodes the acidic form of complement factor 4, part of the classical activation pathway. The gene product is expressed as a single chain precursor which is proteolytically cleaved into a trimer of alpha, beta, and gamma chains prior to secretion. The trimer provides a surface for interaction between the antigen-antibody complex and other complement components. The alpha chain may be cleaved to release C4 anaphylatoxin, a mediator of local inflammation. Deficiency of complement component 4A is associated with systemic lupus erythematosus and type I diabetes mellitus. C4A gene localizes to the major histocompatibility complex (MHC) class III region on chromosome 6. Varying haplotypes of this gene cluster exist, such that individuals may have 1, 2, or 3 copies of this gene.

Fragments of CPS 181 (nucleotides 1 to 45 and nucleotides 199 to 248 of SEQ ID NO: 173) also align with LOC220819 with 100% sequence identity. LOC220819 encodes a protein similar to dJ34F7.4 (complement component 4A). LOC220819 is located on chromosome 6.

In addition, CPS 181 aligns with C4B with over 94% sequence identity. C4B encodes complement component 4B, and has LocusID: 721. C4B is located at chromosome 6p21.3. C4B gene encodes the basic form of complement factor 4, part of the classical activation pathway. This gene exists as a long form and a short form due to the presence or absence of a 6.4 kb endogenous HERV-K retrovirus in intron 9.

CPS 182 corresponds to GPR12 which encodes G protein-coupled receptor 12. The gene has LocusID: 2835, and is located on chromosome 13 with reported cytogenetic location 13q12. The gene product is a member of the G protein-coupled receptor family. It is similar to murine Gpcr12 and rat Rn.10218.

CPS 182 also aligns with a sequence near LOC202175 with 97% sequence identity. LOC202175 is located at chromosome 5p15.33.

CPS 183 corresponds to ADFP which encodes adipose differentiation-related protein. The gene has LocusID: 123, and is located on chromosome 9 with reported cytogenetic location 9p21.2. Adipocyte differentiation-related protein is associated with the globule surface membrane material. This protein is a major constituent of the globule surface. Increase in mRNA levels is one of the earliest indications of adipocyte differentiation. The protein is a component of milk lipid globules. The protein is also known as adipophilin.

Nucleotides 1 to 1314 of SEQ ID NO: 175 (X97324) have 91-92% sequence identity with ILF2 which encodes interleukin enhancer binding factor 2, 45 kD. ILF2 has LocusID: 3608, and is located at chromosome 1q21.1. The gene product is a subunit of nuclear factor of activated T-cells (NF-AT). It is a DNA-binding transcription factor.

CPS 184 corresponds to MYL5 which encodes myosin, light polypeptide 5, regulatory. The gene has LocusID: 4636, and is located on chromosome 4 with reported cytogenetic location 4p16.3. This gene encodes one of the myosin light chains, a component of the hexameric ATPase cellular motor protein myosin. Myosin is composed of two heavy chains, two nonphosphorylatable alkali light chains, and two phosphorylatable regulatory light chains. This gene product, one of the regulatory light chains, is expressed in fetal muscle and in adult retina, cerebellum, and basal ganglia. The gene product may modulate the interaction between myosin and actin. It is a member of a family of mysosin and actin regulatory proteins.

CPS 185 corresponds to DPM2 which encodes dolichyl-phosphate mannosyltransferase polypeptide 2, regulatory subunit. The gene has LocusID: 8818, and is located on chromosome 9 with reported cytogenetic location 9q34.13.

CPS 186 corresponds to MCC which encodes a protein mutated in colorectal cancers. The gene has LocusID: 4163, and is located on chromosome 5 with reported cytogenetic location 5q21-q22. MCC is a candidate for the putative colorectal tumor suppressor gene. The MCC gene product may be involved in early stages of colorectal neoplasia in both sporadic and familial tumors. The gene product is similar to the G protein-coupled m3 muscarinic acetylcholine receptor.

CPS 187 corresponds to F3 which encodes coagulation factor III (thromboplastin, tissue factor). The gene has LocusID: 2152, and is located on chromosome 1 with reported cytogenetic location 1p22-p21. This gene encodes coagulation factor III which is a cell surface glycoprotein. This factor enables cells to initiate the blood coagulation cascades, and it functions as the high-affinity receptor for the coagulation factor VII. The resulting complex provides a catalytic event that is responsible for initiation of the coagulation protease cascades by specific limited proteolysis. Unlike some of other cofactors of these protease cascades, which circulate as nonfunctional precursors, coagulation factor III is a potent initiator that is fully functional when expressed on cell surfaces. There are 3 distinct domains of this factor: extracellular, transmembrane, and cytoplasmic. Coagulation factor III can initiate the coagulation protease cascade assembly and propagation, and may function in normal hemostasis. The factor is a component of the cellular immune response.

CPS 188 corresponds to KLF1 which encodes Kruppel-like factor 1 (erythroid). The gene has LocusID: 10661, and is located on chromosome 19 with reported cytogenetic location 19p13.13-p13.12. Erythroid Kruppel-like factor 1 is a transcriptional activator of the adult beta-globin promoter.

CPS 188 also aligns to LOC146544 with about 94% sequence identity. LOC146544 is located on chromosome 16.

CPS 189 corresponds to HBG2. HBG2 encodes hemoglobin, gamma G. The gene has LocusID: 3047, and is located on chromosome 11 with reported cytogenetic location 11p15.5. HBG1 is also located in the same chromosomal region. The gamma globin genes (HBG1 and HBG2) are normally expressed in the fetal liver, spleen and bone marrow. Two gamma chains together with two alpha chains constitute fetal hemoglobin (HbF) which is normally replaced by adult hemoglobin (HbA) at birth. In some beta-thalassemias and related conditions, gamma chain production continues into adulthood. The two types of gamma chains differ at residue 136 where glycine is found in the G-gamma product (HBG2) and alanine is found in the A-gamma product (HBG1). The former is predominant at birth. The order of the genes in the beta-globin cluster is: 5'-epsilon—gamma-G—gamma-A—delta—beta—3'. The gene product(s) can transport oxygen and carbon dioxide between lung and tissues.

A fragment of CPS 189 (nucleotides 332 . . . 234 of SEQ ID NO: 181) has 86% sequence identity with HBE1 which encodes hemoglobin, epsilon 1.

In addition, SEQ ID NO: 277 (M91036) can be used to design probes for detecting HBG2. Nucleotides 2162-2268, 2391-2614 and 3501-3565 of SEQ ID NO: 277 align to HBG2 with 100% sequence identity. Nucleotides 2379 to 2626 and 7309 to 7556 of SEQ ID NO: 277 have 87% sequence identity with HBE1 which encodes hemoglobin, epsilon 1. HBE1 gene has LocusID: 3046, and is located at chromosome 11p15.5. Nucleotides 2384 to 2621 and 7314 to 7551 of SEQ ID NO: 277 also have 84% sequence identity with a chromosomal region on chromosome 11.

CPS 190 corresponds to GRO3 which encodes GRO3 oncogene. The gene has LocusID: 2921, and is located on chromosome 4 with reported cytogenetic location 4q21. The gene product may be a mitogenic factor.

Nucleotides 6 to 298 of SEQ ID NO: 182 (M36821) have about 86-95% sequence identity with GRO1 and GRO2. GRO1 encodes GRO1 oncogene (melanoma growth stimulating activity, alpha), and has LocusID: 2919. GRO1 is located at chromosome 4q21. GRO1 gene product has melanoma growth stimulating activity, and may be a mitogenic factor involved in inflammatory processes. GRO2 encodes GRO2 oncogene, and has LocusID: 2920. GRO2 is located at chromosome 4q21. GRO2 gene product may be a chemotactic agent for polymorphonuclear leukocytes.

Affymetrix annotation suggests that CPS 191 corresponds to PLEC1. Blast search against the Entrez human genome database shows that nucleotides 14629 to 14800 of SEQ ID NO: 183 (U53204) have 93% sequence identity with LOC162613 and a chromosomal region near LOC93232. Both LOC162613 and LOC93232 are located at chromosome 17q25.3, and encode proteins similar to KIAA1640 protein. In addition, nucleotides 14268 to 14800 of SEQ ID NO: 183 (U53204) align with LOC160535 with 88% sequence identity. LOC160535 is located at chromosome 12q12.

CPS 192 corresponds to SLC16A3 which encodes solute carrier family 16 (monocarboxylic acid transporters), member 3. The gene has LocusID: 9123, and is located on chromosome 17. The gene product is a member of monocarboxylate transporter family, and may function as a transporter. Nucleotides 34 to 945 of SEQ ID NO: 184 (U81800) align with LOC201281 with over 96% sequence identity. LOC201281 encodes a protein similar to monocarboxylate transporter, and is located at chromosome 17q25.3.

CPS 194 corresponds to FKBP8 which encodes FK506 binding protein 8 (38 kD). The gene has LocusID: 23770, and is located on chromosome 19 with reported cytogenetic location 19p12. The protein encoded by this gene is a member of the immunophilin protein family, which play a role in immunoregulation and basic cellular processes involving protein folding and trafficking. The encoded protein does not seem to have PPIase/rotamase activity. It has a three-unit tetratricopeptide repeat and a consensus leucine-zipper repeat, and may have a role in neurons associated with memory function.

CPS 194 also aligns with an intron sequence of PPP1R12B with about 88% sequence identity. PPP1R12B encodes protein phosphatase 1, regulatory (inhibitor) subunit 12B. The gene has LocusID: 4660, and is located on chromosome 1 with reported cytogenetic location 1q32.1. Myosin light chain phosphatase (MLCP) consists of three subunits: the catalytic subunit, the large subunit/myosin binding subunit (MBS) and the small subunit (sm-M20). PPP1R12B is a multi-functional gene which encodes both MBS and sm-M20. MLCP regulates myosins and the dephosphorylation is enhanced by the presence of MBS. The sm-M20 subunit is suggested to play a regulatory role in muscle contraction by binding to MBS. MBS is also encoded by another gene, myosin light chain phosphatase target subunit 1. Although both MBSs increase the activity of MLCP, myosin light chain phosphatase target subunit 1-MBS is a more efficient activator. There are at least four alternatively spliced transcript variants of PPP1R12B described, two altering the MBS coding region and two altering the sm-M20 coding region.

CPS 195 corresponds to RNASE2 which encodes ribonuclease, RNase A family, 2 (liver, eosinophil-derived neurotoxin). The gene has LocusID: 6036, and is located on chromosome 14 with reported cytogenetic location 14q24-q31. Eosinophil-derived neurotoxin has neurotoxic and ribonuclease activities. It is a member of the ribonuclease superfamily.

CPS 195 also aligns with LOC122661 with about 92% sequence identity. LOC122661 encodes a protein similar to nonsecretory ribonuclease precursor (ribonuclease US) (eosinophil-derived neurotoxin) (RNase UpI-2) (ribonuclease 2) (RNase 2). LOC122661 is located at chromosome 14q11.1. In addition, CPS 195 has about 88-94% sequence identity with RNASE3. RNASE3 encodes ribonuclease, RNase A family, 3 (eosinophil cationic protein). RNASE3 has LocusID: 6037, and is located at chromosome 14q24-q31. RNASE3 gene product has neurotoxic and ribonuclease activities. It is a member of the ribonuclease superfamily.

Nucleotides 639 to 735 of SEQ ID NO: 186 (X55988) show 95% sequence identity with an intron sequence of LOC159655. LOC159655 is located at chromosome 10q23.33.

CPS 196 corresponds to BCAT1 which encodes branched chain aminotransferase 1, cytosolic. The gene has LocusID: 586, and is located on chromosome 12 with reported cytogenetic location 12pter-q12. The lack of the cytosolic enzyme branched-chain amino acid transaminase (BCT) causes cell growth inhibition. There may be 2 different clinical disorders due to a defect of branched-chain amino acid transamination: hypervalinemia and hyperleucine-isoleucinemia. Cytosolic branched-chain amino acid aminotransferase 1 catalyzes conversion of branched-chain a-keto acids to L-amino acids.

CPS 199 corresponds to SPP1 which encodes secreted phosphoprotein 1 (osteopontin, bone sialoprotein I, early T-lymphocyte activation 1). The gene has LocusID: 6696, and is located on chromosome 4 with reported cytogenetic location 4q21-q25. Osteopontin (bone sialoprotein) is a bone and blood vessel extracellular matrix protein involved in calcification and atherosclerosis.

CPS 201 corresponds to GRO1 which encodes GRO1 oncogene (melanoma growth stimulating activity, alpha). The gene has LocusID: 2919, and is located on chromosome 4 with reported cytogenetic location 4q21. The gene product has melanoma growth stimulating activity, and may be a mitogenic factor involved in inflammatory processes.

CPS 201 also aligns with GRO2, which encodes GRO2 oncogene, with 87-89% sequence identity. GRO2 has LocusID: 2920, and is located at chromosome 4q21. GRO2 may be a chemotactic agent for polymorphonuclear leukocytes.

Nucleotides 1 to 830 of SEQ ID NO: 189 (X54489) have about 90% sequence identity with GRO3 which encodes GRO3 oncogene. GRO3 has LocusID: 2921, and is located at chromosome 4q21. GRO3 gene product may be a mitogenic factor. Nucleotides 2 to 466 of SEQ ID NO: 189 have 85% sequence identity with LOC201963 which encodes a protein similar to heterogeneous nuclear ribonucleoprotein A1 (helix-destabilizing protein) (single-strand binding protein) (hnRNP core protein A1) (HDP). LOC201963 is located at chromosome 4q13.3.

CPS 202 corresponds to FLJ21588 (DKFZP58600223) which encodes ASC-1 complex subunit P100. The gene has LocusID: 84164, and is located on chromosome 22 with reported cytogenetic location 22q12.1.

CPS 205 corresponds to FASN which encodes fatty acid synthase. The gene has LocusID: 2194, and is located on chromosome 17 with reported cytogenetic location 17q25. The enzyme encoded by this gene is a multifunctional protein. One of its functions is to catalyze the synthesis of palmitate from acetyl-CoA and malonyl-CoA, in the presence of NADPH, into long-chain saturated fatty acids. In some cancer cell lines, this protein has been found to be fused with estrogen receptor-alpha (ER-alpha), in which the N-terminus of FAS is fused in-frame with the C-terminus of ER-alpha.

Nucleotides 7777 to 8199 and 8270 to 8457 of SEQ ID NO: 192 (U29344) have about 94-96% sequence identity with LOC133934. The gene is a hypothetical gene, and is located at chromosome 5p15.2. Nucleotides 7528 to 8223 of SEQ ID NO: 192 show 84% sequence identity with an intron sequence of LY9 which encodes lymphocyte antigen 9. LY9 has LocusID: 4063, and is located at chromosome 1q21.3-q22. Lymphocyte antigen 9 may be involved in adhesion between T cells and accessory cells. It is a member of the immunoglobulin superfamily. In addition, nucleotides 8299 to 8337 of U29344 align with DDX27 with 97% sequence identity. DDX27 encodes DEAD/H (Asp-Glu-Ala-Asp/His) box polypeptide 27, and has LocusID: 55661. DDX27 is located at chromosome 20q13.13. DEAD box proteins, characterized by the conserved motif Asp-Glu-Ala-Asp (DEAD), are putative RNA helicases. They are implicated in a number of cellular processes involving alteration of RNA secondary structure such as translation initiation, nuclear and mitochondrial splicing, and ribosome and spliceosome assembly. Based on their distribution patterns, some members of this family are believed to be involved in embryogenesis, spermatogenesis, and cellular growth and division. DDX27 encodes a DEAD box protein which is a member of the DEAD/DEAH box ATP-dependent RNA or DNA helicase family.

CPS 206 corresponds to HOXA1 which encodes homeo box A1. The gene has LocusID: 3198, and is located on chromosome 7 with reported cytogenetic location 7p15.3. Homeo box A1 is a member of homeodomain family of DNA binding proteins, and may regulate gene expression, morphogenesis, and differentiation.

CPS 207 corresponds to HMOX1 which encodes heme oxygenase (decycling) 1. The gene has LocusID: 3162, and is located on chromosome 22 with reported cytogenetic location 22q13.1. CPS 207 aligns with nucleotides 15085942 to 15086457 of chromosome 22 with 100% sequence identity. Heme oxygenase, an essential enzyme in heme catabolism, cleaves heme to form biliverdin, which is subsequently converted to bilirubin by biliverdin reductase, and carbon monoxide, a putative neurotransmitter. Heme oxygenase activity is induced by its substrate heme and by various nonheme substances. Heme oxygenase occurs as 2 isozymes, an inducible heme oxygenase-1 and a constitutive heme oxygenase-2. HMOX1 and HMOX2 belong to the heme oxygenase family.

The chromosomal region to which CPS 207 aligns is in the proximity of other genes. These genes include MCM5 and LOC129121. MCM5 encodes MCM5 minichromosome maintenance deficient 5, cell division cycle 46 (S. cerevisiae). It is LocusID: 4174, and located at chromosome 22q13.1. The protein encoded by MCM5 is similar to S. cerevisiae CDC46 which is involved in the initiation of DNA synthesis. MCM5 gene product is a member of the MCM family of chromatin-binding proteins. LOC129121 is a hypothetical gene LOC129121 which is located at chromosome 22q12.3.

Nucleotides 26880 to 28079 of SEQ ID NO: 194 (Z82244) align with LOC168550 with 79% sequence identity. LOC168550 encodes a protein similar to pol protein. LOC168550 is located at chromosome 7q36.1. Nucleotides 26774 to 28057 of SEQ ID NO: 194 align with LOC205176 with 76% sequence identity. LOC205176 is located at chromosome 2p12.

Affymetrix annotation suggests that CPS 208 corresponds to BNIP3. Blast search against the Entrez human genome database shows that CPS 208 also aligns with LOC159348 with over 98% sequence identity. LOC159348 is located on chromosome 10 with reported cytogenetic location 10q26.3. In addition, CPS 208 aligns with a chromosomal region on chromosome 14 with about 97% sequence identity. CPS 208 also has about 81% sequence identity with an intron sequence of LOC146062. LOC146062 encodes a protein similar to FLJ00088 protein, and is located at chromosome 15q14.

Nucleotides 152 to 1081 of SEQ ID NO: 195 (AF002697) align with a chromosomal region near LOC152687 with 78% sequence identity. LOC152687 encodes a protein similar to Zinc finger protein 91 (zinc finger protein HTF10) (HPF7), and is located at chromosome 4p16.3.

CPS 209 corresponds to ZNF261 which encodes zinc finger protein 261. The gene has LocusID: 9203, and is located on chromosome X with reported cytogenetic location Xq13.1. The gene product contains a putative zinc-binding motif (MYM).

CPS 210 corresponds to MYH7 which encodes myosin, heavy polypeptide 7, cardiac muscle, beta. The gene has LocusID: 4625, and is located on chromosome 14 with reported cytogenetic location 14q12. MYH7 encodes the cardiac muscle beta (or slow) isoform of myosin. Changes in the relative abundance of MYH7 gene product and MYH6 gene product (the alpha, or fast, isoform of cardiac myosin heavy chain) correlate with the contractile velocity of cardiac muscle. Mutations in MYH7 are associated with familial hypertrophic cardiomyopathy. MYH7 gene product is a member of the motor protein family that provide force for muscle contraction.

Nucleotides 432 to 5869 of SEQ ID NO: 197 (M58018) align with MYH6 with about 88-98% sequence identity. In particular, nucleotides 5741 to 5869 align with MYH6 with 96% sequence identity. MYH6 encodes myosin, heavy polypeptide 6, cardiac muscle, alpha (cardiomyopathy, hypertrophic 1). It has LocusID: 4624, and is located at chromosome 14q12. Cardiac myosin heavy chain 6 alpha is a member of motor protein family that provide force for muscle contraction.

Various fragments in nucleotides 432 to 5543 of M58018 have about 77-90% sequence identity with MYH1, MYH2, MYH3, MYH4 and MYH13. MYH1 encodes myosin, heavy polypeptide 1, skeletal muscle, adult, and has LocusID: 4619. MYH2 encodes myosin, heavy polypeptide 2, skeletal muscle, adult, and has LocusID: 4620. MYH3 encodes myosin, heavy polypeptide 3, skeletal muscle, embryonic, and has LocusID: 4621. MYH4 encodes myosin, heavy polypeptide 4, skeletal muscle, and has LocusID: 4622. MYH13 encodes myosin, heavy polypeptide 13, skeletal muscle, and has LocusID: 8735. MYH1, MYH2, MYH3 and MYH4 are all reportedly located at chromosome 17p13.1. MYH13 has reported cytogenetic location 17p13.

Myosin is a major contractile protein which converts chemical energy into mechanical energy through the hydrolysis of ATP. Myosin is a hexameric protein composed of a pair of myosin heavy chains (MYH) and two pairs of nonidentical light chains. Myosin heavy chains are encoded by a multigene family. In mammals at least 10 different myosin heavy chain (MYH) isoforms have been described from striated, smooth, and nonmuscle cells. These isoforms show expression that is spatially and temporally regulated during development. The proteins encoded by MYH1, MYH4 and MYH13 contain ATPase head and rod-like tail domains. Myosin heavy chain 1 and 13 may provide force for muscle contraction, cytokinesis and phagocytosis. Skeletal muscle myosin heavy chain 3 and 4 may provide force for muscle contraction.

In addition, nucleotides 1494 to 1654 of M58018 align with MYH7B and a chromosomal region near FLJ22037 with about 88-92% sequence identity. FLJ22037 encodes hypothetical protein FLJ22037, and has LocusID: 84176. It is located on chromosome. 7 with reported cytogenetic location 7q11.21. MYH7B encodes myosin, heavy polypeptide 7B, cardiac muscle, beta. MYH7B has LocusID: 57644, and is located at chromosome 20q11.21.

CPS 211 corresponds to IL1B which encodes interleukin 1, beta. The gene has LocusID: 3553, and is located on chromosome 2 with reported cytogenetic location 2q14. Interleukin 1 beta may initiate and amplify the immune and inflammatory responses.

CPS 212 corresponds to STX1A which encodes syntaxin 1A (brain). The gene has LocusID: 6804, and is located on chromosome 7 with reported cytogenetic location 7q11.23. Syntaxin 1A (brain) may be involved in intracellular transport and neurotransmitter release CPS 213 corresponds to ATPASEP (ATP9B) which encodes ATPase type IV, phospholipid transporting (P-type) (putative) (ATPase, Class II, type 9B). The gene has LocusID: 11071, and is located on chromosome 18 with reported cytogenetic location 18q23.

CPS 214 corresponds to CR1 which encodes complement component (3b/4b) receptor 1, including Knops blood group system. The gene has LocusID: 1378, and is located on chromosome 1 with reported cytogenetic location 1q32. The gene comprises 2769865 to 2857756 nucleotides of chromosome 1. This gene encodes a membrane glycoprotein found on peripheral blood cells, glomerular podocytes, and follicular dendritic cells. The protein encoded by the gene is a receptor for complement components C3b and C4b and regulates the activity of the complement cascade. Variation in the encoded protein is the basis of the Knops blood group system. The two common alleles, F and S, differ by 8 exons and are thought to be the result of an unequal crossover event. A secreted form of the encoded protein present in plasma has been described, but its full length nature has not been determined. The encoded protein has short consensus repeats (SCRs).

CPS 214 also aligns with CR1L with about 93% sequence identity. CR1L encodes complement component (3b/4b) receptor 1-like. It has LocusID: 1379, and is located at chromosome 1q32.1.

CPS 215 corresponds to DKFZP586M1523 which encodes DKFZP586M1523 protein. The gene has LocusID: 25941, and is located on chromosome 18 with reported cytogenetic location 18q12.1.

CPS 215 also aligns with LOC201347 with over 99% sequence identity. LOC201347 is located in an intron of BRUNOL4 which encodes bruno-like 4, RNA binding protein (Drosophila). BRUNOL4 has LocusID: 56853, and is located on chromosome 18 with reported cytogenetic location 18q12.

CPS 216 corresponds to KRT1 which encodes keratin 1 (epidermolytic hyperkeratosis). The gene has LocusID: 3848, and is located on chromosome 12 with reported cytogenetic location 12q12-q13. The protein encoded by this gene is a member of the keratin gene family. The type II cytokeratins include basic or neutral proteins which are arranged in pairs of heterotypic keratin chains coexpressed during differentiation of simple and stratified epithelial tissues. The type II cytokeratin encoded by KRT1 can be expressed in the spinous and granular layers of the epidermis with family member KRT10. Mutations in KRT1 and KRT10 genes may be associated with bullous congenital ichthyosiform erythroderma. The type II cytokeratins are clustered in a region of chromosome 12q12-q13.

Nucleotides 4076 to 4275 of SEQ ID NO: 203 (M98776) have 87% sequence identity with KRT2A. KRT2A encodes keratin 2A (epidermal ichthyosis bullosa of Siemens). The gene has LocusID: 3849, and is located on chromosome 12 with reported cytogenetic location 12q11-q13. KRT2A gene is a member of the keratin gene family. The protein encoded by KRT2A gene is expressed in the upper spinous layer of epidermal keratinocytes. Mutations in this gene may be associated with bullous congenital ichthyosiform erythroderma. Keratin 2A is an intermediate filament component that may have a role in terminal cornification of epidermal keratinocytes. Nucleotides 3203 to 3246 of SEQ ID NO: 203 have 93% sequence identity with an intron sequence of LOC221618 which is located at chromosome 6p21.32.

CPS 217 corresponds to UNK_AF070571 (EXT1). CPS 217 aligns to the 3' untranslated region of EXT1. EXT1 encodes exostoses (multiple) 1, and has LocusID: 2131 with reported cytogenetic location 8q24.11-q24.13. Exostoses (multiple) 1 (EXT1) is an ER-resident type II transmembrane glycosyltransferase involved in the chain elongation step of heparan sulfate biosynthesis. It is involved in hereditary multiple exostoses, a disorder characterized by cartilaginous excrescences near the ends of the diaphyses of the bones of the extremities.

CPS 218 corresponds to PPP3CB which encodes protein phosphatase 3 (formerly 2B), catalytic subunit, beta isoform (calcineurin A beta). The gene has LocusID: 5532, and is located on chromosome 10 with reported cytogenetic location 10q21-q22. The product encoded by the gene, which is also known as catalytic subunit of calmodulin regulated protein phosphatase 3, may regulate activity of transcription factors involved in signal transduction and growth control.

CPS 219 corresponds to QSCN6 which encodes quiescin Q6. The gene has LocusID: 5768, and is located on chromosome 1 with reported cytogenetic location 1q24. The protein encoded by the gene contains domains of thioredoxin and ERV1, members of two long-standing gene families. The expression of QSCN6 gene is induced when fibroblasts begin to exit the proliferative cycle and enter quiescence, suggesting that QSCN6 gene may play a role in growth regulation. Quiescin Q6 has similarity to thioredoxins and *S. cerevisiae* Erv1p.

CPS 220 corresponds to PRF1 which encodes perforin 1 (pore forming protein). The gene has LocusID: 5551, and is located on chromosome 10 with reported cytogenetic location 10q22. Perforin 1 is a cytolytic, channel-forming protein, and may play a role in clearing virally infected host cells and tumor cells. CPS 220 is located in the 3' untranslated region of the gene.

Affymetrix annotation suggests that CPS 221 corresponds to FCGR3B. FCGR3B encodes Fc fragment of IgG, low affinity IIIb, receptor for (CD 16). The gene has LocusID: 2215, and is located at chromosome 1q23.

Blast search against the Entrez human genome database shows that CPS 221 also aligns with FCGR3A with over 97% sequence identity. FCGR3A encodes Fc fragment of IgG, low affinity 111a, receptor for (CD16). FCGR3A has LocusID: 2214, and is located on chromosome 1 with reported cytogenetic location 1q23. FCGR3A gene product is a Type III Fc gamma receptor. It can associate with zeta chain of the T-cell receptor complex (CD3Z), and is a member of the immunoglobulin superfamily. FCGR3B gene is located 3' to FCGR3A gene on chromosome 1.

CPS 222 corresponds to PTGS2 which encodes prostaglandin-endoperoxide synthase 2 (prostaglandin G/H synthase and cyclooxygenase). The gene has LocusID: 5743, and is located on chromosome 1 with reported cytogenetic location 1q25.2-q25.3. Prostaglandin-endoperoxide synthase (PTGS), also known as cyclooxygenase, is a key enzyme in prostaglandin biosynthesis, and acts both as a dioxygenase and as a peroxidase. There are two isozymes of PTGS: a constitutive PTGS1 and an inducible PTGS2. The two isoforms differ in their regulation of expression and tissue distribution PTGS2 gene encodes PTGS2 protein, which shows 86-89% amino acid sequence identity with mouse, rat, sheep, bovine, horse and rabbit PTGS2 proteins. Human PTGS2 gene appears to be expressed in a limited number of cell types and regulated by specific stimulatory events, suggesting that it may be responsible for the prostanoid biosynthesis involved in inflammation and mitogenesis. The expression of PTGS2 gene may be deregulated in epithelial tumors. PTGS2 protein may regulate angiogenesis and cell migration, and catalyze the rate-limiting step in the formation of inflammatory prostaglandins.

CPS 223 corresponds to OPHN1 which encodes oligophrenin 1. The gene has LocusID: 4983, and is located on chromosome X with reported cytogenetic location Xq12. Oligophrenin 1 has at least 25 exons and may encode a Rho-GTPase-activating protein. The Rho proteins are important mediators of intracellular signal transduction which affects cell migration and cell morphogenesis. Mutations in OPHN1 gene may be responsible for non-specific X-linked mental retardation. Nucleotides 2971 to 3363 of SEQ ID NO: 210 (AJ001189) have 84% sequence identity with an intron sequence of putative gene LOC200861 which is located at chromosome 3p24.1.

CPS 224 corresponds to VSNL1 which encodes visinin-like 1. The gene has LocusID: 7447, and is located on chromosome 2 with reported cytogenetic location 2p24.3. Visinin-like protein 1 may bind calcium. The protein is similar to rat Vsnl1.

CPS 225 corresponds to FECH which encodes ferrochelatase (protoporphyria). The gene has LocusID: 2235, and is located on chromosome 18 with reported cytogenetic location 18q21.3. Ferrochelatase is localized to the mitochondrion where it catalyzes the insertion of ferrous form of iron into protoporphyrin IX in the heme synthesis pathway. Defects in ferrochelatase are associated with protoporphyria. CPS 225 is located in the 3' untranslated region of the gene.

SEQ ID NO: 282 (D00726) also aligns to FECH with over 97% sequence identity, and can be used to design probes for detecting the expression level of FECH. Nucleotides 167 to 1972 of SEQ ID NO: 282 have 82-84% sequence identity with LOC205467. LOC205467 is a putative gene, and located on chromosome 3 with reported cytogenetic location 3p22.1.

CPS 226 corresponds to KIAA0483 which encodes KIAA0483 protein. The gene has LocusID: 23219, and is located on chromosome 1 with reported cytogenetic location 1q41. CPS 227 corresponds to HK3 which encodes hexokinase 3 (white cell). The gene has LocusID: 3101, and is located on chromosome 5 with reported cytogenetic location 5q35.2. Hexokinases phosphorylate glucose to produce glucose-6-phosphate, thus committing glucose to the glycolytic pathway. HK3 gene encodes hexokinase 3 which is similar to hexokinases 1 and 2. Hexokinase 3 is an allosteric enzyme and can be inhibited by its product glucose-6-phosphate.

CPS 228 corresponds to MS4A3 which encodes membrane-spanning 4-domains, subfamily A, member 3 (hematopoietic cell-specific). The gene has LocusID: 932, and is located on chromosome 11 with reported cytogenetic location 11q12-q13.1. The gene product has low similarity to CD20 and the beta subunit of FCER1B. It contains four predicted membrane-spanning domains, and may play a role in signal transduction.

CPS 229 corresponds to SCYA20 which encodes small inducible cytokine subfamily A (Cys-Cys), member 20. The gene has LocusID: 6364, and is located on chromosome 2 with reported cytogenetic location 2q33-q37. The gene product Cytokine A20 (exodus) is a chemotactic factor for lymphocytes, but not a chemotactic factor for monocytes.

CPS 230 corresponds to C1QR1 which encodes complement component 1, q subcomponent, receptor 1. The gene has LocusID: 22918, and is located on chromosome 20 with reported cytogenetic location 20p11.21. This gene encodes a type I membrane protein. The encoded protein acts as a receptor for complement protein C1q, mannose-binding lectin, and pulmonary surfactant protein A. The protein is a functional receptor involved in ligand-mediated enhancement of phagocytosis. It may play a role in phagocytic destruction of pathogens and immune complexes.

CPS 230 also aligns with a chromosomal region near putative gene LOC200421 with about 99% sequence identity. LOC200421 has reported cytogenetic location 2p12.

CPS 231 corresponds to POU1F1 which encodes POU domain, class 1, transcription factor 1 (Pit1, growth hormone factor 1). The gene has LocusID: 5449, and is located on chromosome 3 with reported cytogenetic location 3p11. The gene product, also known as POU homeodomain transcription factor 1, may regulate PRL, GH and TSH genes.

CPS 232 corresponds to TKTL1 which encodes transketolase-like 1. The gene has LocusID: 8277, and is located on chromosome X with reported cytogenetic location Xq28. Transketolase 1 is a thiamine pyrophosphate-dependent enzyme in the pentose phosphate pathway.

CPS 234 corresponds to CCNT2 which encodes cyclin T2. The gene has LocusID: 905, and is located on chromosome 2 with reported cytogenetic location 2q14.3. The protein encoded by this gene belongs to a highly conserved cyclin family, whose members are characterized by a dramatic periodicity in protein abundance through the cell cycle. Cyclins function as regulators of CDK kinases. Different cyclins exhibit distinct expression and degradation patterns which contribute to the temporal coordination of each mitotic event. Cyclin T2 and its kinase partner CDK9 were found to be subunits of the transcription elongation factor p-TEFb. The p-TEFb complex containing cyclin T2 was reported to interact with, and act as a negative regulator of human immunodeficiency virus type 1 (HIV-1) Tat protein. At least two alternatively spliced transcript variants, which encode distinct isoforms, have been described.

Nucleotides 261 to 723 and 936 to 1349 of SEQ ID NO: 220 (AF048732) have about 88% sequence identity to a chromosomal region on chromosome 1.

CPS 235 corresponds to ATP6V1H which encodes ATPase, H+ transporting, lysosomal 50/57 kD V1 subunit H. The gene has LocusID: 51606, and is located on chromosome 8 with reported cytogenetic location 8p22-q22.3. The polypeptide encoded by the gene is also known as CGI-11 protein [H.sapiens]. An intron of ATP6V1H gene includes RGS20 gene. RGS20 encodes regulator of G-protein signalling 20, and has LocusID: 8601.

CPS 236 corresponds to FN1 which encodes fibronectin 1. The gene has LocusID: 2335, and is located on chromosome 2 with reported cytogenetic location 2q34. Fibronectin is a glycoprotein present in a soluble dimeric form in plasma, and in a dimeric or multimeric form at the cell surface and in extracellular matrix. Fibronectin is involved in cell adhesion and migration processes including embryogenesis, wound healing, blood coagulation, host defense, and metastasis. FN1 gene has three regions subject to alternative splicing, with the potential to produce 20 different transcript variants.

CPS 237 corresponds to UNK_J04178 which is located in an intron of HEXA. HEXA encodes hexosaminidase A (alpha polypeptide). HEXA has LocusID: 3073, and is located on chromosome 15 with reported cytogenetic location 15q23- q24. Hexosaminidase A is the alpha subunit of the lysosomal enzyme beta-hexosaminidase which, together with the cofactor GM2 activator protein, catalyzes the degradation of the ganglioside GM2, and other molecules containing terminal N-acetyl hexosamines. Beta-hexosaminidase is composed of two subunits, alpha and beta, which are encoded by separate genes. Both beta-hexosaminidase alpha and beta subunits are members of family 20 of glycosyl hydrolases. Mutations in the alpha or beta subunit genes may lead to an accumulation of GM2 ganglioside in neurons and neurodegenerative disorders termed the GM2 gangliosidoses. Alpha subunit gene mutations may lead to Tay-Sachs disease (GM2-gangliosidosis type I). The chromosomal region that aligns to CPS 237 is located in an intron of HEXA.

CPS 237 also aligns with LOC145709 which is a hypothetical gene supported by J04178. LOC145709 has reported cytogenetic location 15q22.32.

CPS 239 corresponds to NR2C1 which encodes nuclear receptor subfamily 2, group C, member 1. The gene has LocusID: 7181, and is located on chromosome 12 with reported cytogenetic location 12q21.32-q21.33. The gene product can exist in multiple isoforms with different ligand-binding domains.

CPS 240 corresponds to RASSF2 (KIAA0168) which encodes Ras association (RalGDS/AF-6) domain family 2. The gene has LocusID: 9770, and is located on chromosome 20 with reported cytogenetic location 20pter-p12.1. The alternative name for this gene product is KIAA0168 protein.

CPS 241 corresponds to IL6 which encodes interleukin 6 (interferon, beta 2). The gene has LocusID: 3569, and is located on chromosome 7 with reported cytogenetic location 7p21. Interleukin 6 (interferon-beta 2) may induce the maturation of B cells into immunoglobulin-secreting cells.

CPS 242 corresponds to KIAA0372 which encodes KIAA0372 gene product. The gene has LocusID: 9652, and is located on chromosome 5 with reported cytogenetic location 5q21.1-q21.2.

CPS 243 corresponds to CYP4F2 which encodes cytochrome P450, subfamily IVF, polypeptide 2. The gene has LocusID: 8529, and is located on chromosome 19 with reported cytogenetic location 19pter-p13.11. This gene encodes a member of the cytochrome P450 superfamily of enzymes. The cytochrome P450 proteins are monooxygenases which catalyze many reactions involved in drug metabolism and synthesis of cholesterol, steroids and other lipids. The cytochrome P450 proteins localize to the endoplasmic reticulum. They may start the process of inactivating and degrading leukotriene B4, a potent mediator of inflammation. CYP4F2 gene is part of a cluster of cytochrome P450 genes on chromosome 19. Another member of this family, CYP4F 11, is approximately 16 kb away.

CPS 243 also aligns with CYP4F3 with about 97% sequence identity. CYP4F3 encodes cytochrome P450, subfamily IVF, polypeptide 3 (leukotriene B4 omega hydroxylase). It has LocusID: 4051, and is located on chromosome 19 with reported cytogenetic location 19p13.2. CYP4F3 encodes a member of the cytochrome P450 superfamily of enzymes. This gene is also part of a cluster of cytochrome P450 genes on chromosome 19. Another member of this family, CYP4F8, is approximately 18 kb away. CYP4F3 gene product may convert leukotriene B4 into the less active 20-hydroxy-leukotriene B4.

Various fragments in nucleotides 253 to 1639 of U02388 (SEQ ID NO: 228) align to various genes with about 83-93% sequence identity. These genes include LOC126538, LOC126537, LOC126407, CYP4F12, and CYP4F8. LOC126538 and LOC126537 encode proteins similar to cytochrome P450, subfamily IVF, polypeptide 2 (leukotriene B4 omega-hydroxylase) (leukotriene-B420-monooxygenase). Both genes are located at chromosome 19p13.12. LOC126407 encodes a protein similar to cytochrome P450, and is located on chromosome 19. CYP4F12 encodes cytochrome P450, subfamily IVF, polypeptide 12. CYP4F12 has LocusID: 66002. CYP4F8 encodes cytochrome P450, subfamily IVF, polypeptide 8, and has LocusID: 11283.

Nucleotides 446 to 1457 of SEQ ID NO: 228 (U02388) also align with a chromosomal region between the coding sequences of LOC222275 and CYP4F11. LOC222275 encodes a protein similar to mitochondrial RNA polymerase, and has reported cytogenetic location 19p13.12. CYP4F11 encodes cytochrome P450, subfamily IVF, polypeptide 11, and has LocusID: 57834. CYP4F11 has reported cytogenetic location 19p13.1.

CPS 244 corresponds to STIP1 which encodes stress-induced-phosphoprotein 1 (Hsp70/Hsp90-organizing protein). The gene has LocusID: 10963, and is located on chromosome 11 with reported cytogenetic location 11q13.

Nucleotides 1 to 1086 of SEQ ID NO: 229 (M86752) have 100% sequence identity with STIP1. STIP1 encodes stress-induced-phosphoprotein 1 (Hsp70/Hsp90-organizing protein). The gene has LocusID: 10963, and is located on chromosome 111 with reported cytogenetic location 11q13. The gene product is similar to S. cerevisiae Sti1p, and has TPR repeats. The sequence alignment between nucleotides 1 to 1086 of M86752 and STIP1 is located in an intron of putative gene LRP16. LRP16 encodes LRP16 protein, and has LocusID: 28992. LRP16 has reported cytogenetic location 11q11. LRP16 gene product contains a region having low similarity to the H2A histone family.

Nucleotides 69 to 1086 of SEQ ID NO: 229 have over 99% sequence identity with a chromosomal region between the coding sequences of NAALADASEL and LOC220489. NAALADASEL encodes N-acetylated alpha-linked acidic dipeptidase-like (ILEAL DIPEPTIDYLPEPTIDASE), and has LocusID: 10004. LOC220489 encodes a protein similar to stress-induced phosphoprotein 1.

Moreover, CPS 244 aligns with LOC170030 and a region near LOC121392 with 85-93% sequence identity. LOC170030 encodes a protein similar to transformation-sensitive protein IEF SSP 3521 (human). It is located at chromosome Xq21.1. LOC121392 encodes a protein similar to keratin complex 2, gene 6g. It is located at chromosome 12q12.

CPS 245 corresponds to SERPINH2 (CBP2) which encodes serine (or cysteine) proteinase inhibitor, clade H (heat shock protein 47), member 2. The gene has LocusID: 872, and is located on chromosome 11 with reported cytogenetic location 11q13.5. The gene product is also known as collagen-binding protein 2 or colligen 2. It is a collagen-binding protein that acts as a heat shock protein.

CPS 245 also aligns with LOC158172 with about 91% sequence identity. LOC158172 encodes a protein similar to collagen-binding protein 2 precursor (colligin 2) (Rheumatoid arthritis related antigen RA-A47). LOC158172 is located at chromosome 9p11.2.

CPS 247 corresponds to NCF1 which encodes neutrophil cytosolic factor 1 (47 kD, chronic granulomatous disease, autosomal 1). The gene has LocusID: 4687, and is located on chromosome 7 with reported cytogenetic location 7q11.23. NCF1 encodes neutrophil cytosolic factor 1, the 47-kilodalton cytosolic subunit of the multi-protein complex known as NADPH oxidase found in neutrophils. This oxidase produces a burst of superoxide which is delivered to the lumen of the neutrophil phagosome. Mutations in NCF1, as well as in other NADPH oxidase subunits, may result in chronic granulomatous disease.

CPS 247 also aligns with LOC220830 with over 95% sequence identity. LOC220830 encodes a protein similar to neutrophil cytosolic factor 1 (47 kD, chronic granulomatous disease, autosomal 1). LOC220830 is located on chromosome 7 with reported cytogenetic location 7p13.

Affymetrix annotation suggests that CPS 248 corresponds to CHN2. Blast search against the Entrez human genome database shows that CPS 248 also aligns to the 3' untranslated region of LOC222172 with 99% sequence identity. LOC222172 encodes Beta-chimaerin (Beta-chimerin). The gene is located on chromosome 7 with reported cytogenetic location 7p21.1-p15.3.

Nucleotides 456 to 2446 of SEQ ID NO: 284 (U07223) align with LOC222172 with over 97% sequence identity. Nucleotides 4 to 473 of SEQ ID NO: 284 (U07223) have 97% sequence identity with GFAP. GFAP encodes glial fibrillary acidic protein. It has LocusID: 2670, and is located on chromosome 17 with reported cytogenetic location 17q21. Glial fibrillary acidic protein is an intermediate filament protein.

CPS 249 corresponds to ABL1 which encodes v-abl Abelson murine leukemia viral oncogene homolog 1. The gene has LocusID: 25, and is located on chromosome 9 with reported cytogenetic location 9q34.1. The ABL1 protooncogene encodes a cytoplasmic and nuclear protein tyrosine kinase that has been implicated in processes of cell differentiation, cell division, cell adhesion, and stress response. Activity of ABL1 protein is negatively regulated by its SH3 domain, and deletion of the SH3 domain turns ABL1 into an oncogene. The t(9;22) translocation results in the head-to-tail fusion of the BCR (MIM:151410) and ABL1 genes present in many cases of chronic myelogeneous leukemia. The DNA-binding activity of the ubiquitously expressed ABL1 tyrosine kinase is regulated by CDC2-mediated phosphorylation, suggesting a cell cycle function for ABL1. The ABL1 gene can be expressed as a 6- or 7-kb mRNA transcript, with alternatively spliced first exons spliced to the common exons 2-11.

CPS 250 corresponds to FLOT1 which encodes flotillin 1. The gene has LocusID: 10211, and is located on chromosome 6 with reported cytogenetic location 6p21.3. Caveolae are small domains on the inner cell membrane involved in vesicular trafficking and signal transduction. FLOT1 encodes a caveolae-associated, integral membrane protein. The function of flotillin 1 has not been determined. Flotillin 1 is similar to murine flotillin (Mm.2931).

CPS 250 also aligns to an intron sequence of LOC203011 with about 91% sequence identity. LOC203011 is located at chromosome 8q23.3.

CPS 251 corresponds to REV3L which encodes REV3-like, catalytic subunit of DNA polymerase zeta (yeast). The gene has LocusID: 5980, and is located on chromosome 6 with reported cytogenetic location 6q21. Catalytic subunit of DNA polymerase zeta acts in translation replication, and may be involved in mutagenesis.

Affymetrix annotation suggests that CPS 252 corresponds to MUC3 which encodes mucin 3, intestinal. The gene has LocusID: 4584, and is located on chromosome 7 with reported cytogenetic location 7q22.

CPS 253 corresponds to SMARCA4 which encodes SWI/SNF related, matrix associated, actin dependent regulator of chromatin, subfamily a, member 4. The gene has LocusID: 6597, and is located on chromosome 19 with reported cytogenetic location 19p13.2. The protein encoded by this gene is a member of the SWI/SNF family of proteins and is similar to the brahma protein of Drosophila. Members of this family have helicase and ATPase activities and are thought to regulate transcription of certain genes by altering the chromatin structure around those genes. The encoded protein is part of the large ATP-dependent chromatin remodeling complex SNF/SWI, which is required for transcriptional activation of genes normally repressed by chromatin. In addition, the encoded protein can bind BRCA1, as well as regulate the expression of the tumorigenic protein CD44. Alternatively spliced transcripts have been found for this gene.

Nucleotides 2063 to 2094 of SEQ ID NO: 238 (U29175) have 100% sequence identity with vairoious regions in the human genome. These regions include LOC203511, which is located at chromosome Xp22.31, and a chromosomal region near LOC200164 on chromosome 1.

CPS 254 corresponds to LOC92684 which encodes hypothetical gene supported by AF035314. The gene is located on chromosome 20 with reported cytogenetic location 20p11.21. The sequence alignment between CPS 254 and LOC92684 is located in an intron of C20orf19. C20orf19 refers to chromosome 20 open reading frame 19. It has LocusID: 55857, and is reportedly located at chromosome 20pter-q11.23.

CPS 255 corresponds to EEF1A2 which encodes eukaryotic translation elongation factor 1 alpha 2. The gene has LocusID: 1917, and is located on chromosome 20 with reported cytogenetic location 20q13.3. The gene product has a guanine nucleotide-binding site, and may be involved in the binding of aminoacyl-tRNA to the ribosome during peptide synthesis.

CPS 256 corresponds to BRF2 (ZFP36L2) which encodes zinc finger protein 36, C3H type-like 2. The gene has LocusID: 678, and is located on chromosome 2 with reported cytogenetic location 2p22.3-p21. This gene is a member of the TIS11 family of early response genes. Family members are induced by various agonists such as the phorbol ester TPA and the polypeptide mitogen EGF. The protein encoded by this gene contains a distinguishing putative zinc finger domain with a repeating cys-his motif. The encoded protein is a putative nuclear transcription factor, and may function in regulating the response to growth factors. The sequence alignment between CPS 256 and BRF2 overlaps LOC151103 and LOC165204.

Nucleotides 3862 to 4187 and 4238 to 4907 of SEQ ID NO: 286 have 84-86% sequence identity to a chromosomal region near LOC143974. LOC143974 is located at chromosome 11p14.1. Nucleotides 5004 to 5497 of SEQ ID NO: 286 align to an intron sequence of KIAA1301 with 82% sequence identity. KIAA1301 encodes KIAA1301 protein, and is located at chromosome 2q33.1.

CPS 257 corresponds to SNRPG which encodes small nuclear ribonucleoprotein polypeptide G. The gene has LocusID: 6637, and is located on chromosome 2 with reported cytogenetic location 2p12. The gene product is also known as spliceosomal snRNA-associated Sm core protein G, and may be involved in the biogenesis of the snRNPs.

CPS 257, or fragments thereof, also aligns to various regions or genes with about 95-96% sequence identity. These regions or genes include a chromosomal region between LOC162681 and LOC125307, an intron sequence of RGS19IP1, an intron sequence of FLJ10748, a chromosomal region near SKD3, POLE2, and an intron sequence of OPTN. Both LOC162681 and LOC125307 have reported cytogenetic location 18q21.2. RGS19IP1 encodes regulator of G-protein signalling 19 interacting protein 1, and has LocusID: 10755. RGS19IP1 is located on chromosome 19 with reported cytogenetic location 19p13.1. FLJ10748 encodes hypothetical protein FLJ10748, and is reportedly located at chromosome 1q31.2. SKD3 encodes suppressor of potassium transport defect 3. It has LocusID: 81570 and reported cytogenetic location 11q13.3. POLE2 encodes polymerase (DNA directed), epsilon 2 (p59 subunit), and has LocusID: 5427. It is located at chromosome 14q21-q22. OPTN encodes optineurin, and has LocusID: 10133. OPTN is located at chromosome 10p12.33.

In addition, fragments of CPS 257 align to various regions or genes with about 85-92% sequence identity. These regions or genes include a chromosomal region near LOC164917, a region located 5' to ABCA5, an intron sequence of KIAA1170, and chromosomal regions near SPG3A, LOC201203, LOC205322, LOC203775 and ERG, respectively. LOC164917 is located at chromosome 2q12.2. ABCA5 encodes ATP-binding cassette, subfamily A (ABC1), member 5. ABCA5 has LocusID: 23461, and is located at chromosome 17q24.3. KIAA1170 encodes KIAA1170 protein, and is located at chromosome 7q31.1. SPG3A encodes spastic paraplegia 3A (autosomal dominant). SPG3A has LocusID: 51062, and is located at chromosome 14q21.3. LOC201203, LOC205322, LOC203775 and ERG are located at chromosome 17q22, 2p23.3, 10q26.2 and 21q22.3, respectively. LOC203775 encodes a protein similar to high mobility group protein 4 (HMG-4) (high mobility group protein 2a) (HMG-2a). ERG encodes v-ets erythroblastosis virus E26 oncogene like (avian), and has LocusID: 2078.

CPS 258 corresponds to NUMA1 which encodes nuclear mitotic apparatus protein 1. The gene has LocusID: 4926, and is located on chromosome 11 with reported cytogenetic location 11q13. The gene product is a structural component of the nucleus. It contains a predicted coiled-coil domain, and is predicted to have a role in nuclear reassembly in late mitosis.

CPS 259 corresponds to AKR1B1 which encodes aldo-keto reductase family 1, member B1 (aldose reductase). The gene has LocusID: 231, and is located on chromosome 7 with reported cytogenetic location 7q35. The gene product is also known as aldo-keto reductase 1B1 (aldose reductase, aldehyde dehydrogenase). It can reduce glucose and other carbonyl-containing substrates. The gene product is a member of the NADPH-dependent aldo-keto reductase superfamily.

Fragments of SEQ ID NO: 289 align to other genes or regions with about 83-92% sequence identity. These genes or regions include LOC126242, LOC163862, LOC131710, LOC145401, LOC170139, LOC125836, and a chromosomal region near LOC220082. LOC126242 encodes a protein similar to aldose reductase (AR) (aldehyde reductase), and is located at chromosome 19q13.12. LOC163862 also encodes a protein similar to aldose reductase. It is located at chromosome 1q41. LOC131710 and LOC125836 encodes proteins similar to aldose reductase (E.C.1.1.1.21) (Mutant With Tyr 48 Replaced By His (Y48h) Complexed With Nadp+ And Citrate), and are located at chromosome 3p13 and 18p11.21, respectively. LOC145401 encodes a protein similar to aldo-keto reductase family 1, member B1 (aldose reductase). LOC145401 is located at chromosome 14q22.3. LOC170139 is located at chromosome Xq23, and encodes a protein similar to aldose reductase (AR) (aldehyde reductase). LOC220082 is located at chromosome 13q14.11.

CPS 260 corresponds to SMARCE1 which encodes SWI/SNF related, matrix associated, actin dependent regulator of chromatin, subfamily e, member 1. The gene has LocusID: 6605, and is located on chromosome 17 with reported cytogenetic location 17q21.1. The protein encoded by this gene is part of the large ATP-dependent chromatin remodeling complex SWI/SNF, which is required for transcriptional activation of genes normally repressed by chromatin. The encoded protein, either alone or when in the SWI/SNF complex, can bind to 4-way junction DNA, which is thought to mimic the topology of DNA as it enters or exits the nucleosome. The encoded protein contains a DNA-binding HMG domain, but disruption of this domain does not abolish the DNA-binding or nucleosome-displacement activities of the SWI/SNF complex. SNF/SWI complex is associated with the nuclear matrix and implicated in regulation of transcription by affecting chromatin structure.

SEQ ID NO: 290 aligns to SMARCE1 with over 98% sequence identity and therefore, can be used to prepare probes directed to SMARCE1. Nucleotides 10 to 1377 of SEQ ID NO: 290 (AF035262) also show about 90-94% sequence identity with LOC160863, LOC145357 and LOC134699. All of these three putative genes encode proteins similar to SWI/SNF related, matrix associated, actin dependent regulator of chromatin, subfamily e, member 1. LOC160863, LOC145357 and LOC134699 are located at chromosome 13q14.11, 14q11.1 and 6q16.1, respectively.

CPS 261 corresponds to KIAA0669 which encodes KIAA0669 gene product. The gene has LocusID: 9819, and is located on chromosome 3 with reported cytogenetic location 3q25.1. Affymetrix annotation suggests that CPS 262 corresponds to MSF which encodes MLL septin-like fusion. The gene has LocusID: 10801, and is located on chromosome 17 with reported cytogenetic location 17q25.

SEQ ID NO: 292 aligns to a chromosomal region on chromosome 17 with over 99% sequence identity. The region includes LOC204508, FLJ12190, LOC204512 and LOC197453. All of these genes have reported cytogenetic location 17q25.3. FLJ12190 has LocusID: 80141. LOC197453 encodes a protein similar to hypothetical protein SBBI23.

CPS 263 corresponds to PTMA which encodes prothymosin, alpha (gene sequence 28). The gene has LocusID: 5757, and is located on chromosome 2 with reported cytogenetic location 2q35-q36. Prothymosin alpha may be associated with cell proliferation.

Nucleotides 43 to 1200 of SEQ ID NO: 293 also align to LOC220771 with 98% sequence identity. LOC220771 encodes prothymosin alpha, and is reportedly located at chromosome 5q23.2. In addition, CPS 263, or fragments thereof, align with LOC145123, LOC220508, a chromosomal region between PZP and DDX12, and an intron sequence of TRIP11 with about 9495% sequence identity. LOC145123 is located at chromosome 13q22.3. LOC220508 encodes prothymosin alpha, and is located at chromosome 12p12.3. PZP encodes pregnancy-zone protein, and has LocusID: 5858. It is located at chromosome 12p13-p12.2. DDX12 encodes DEAD/H (Asp-Glu-Ala-Asp/His) box polypeptide 12 (CHL1-like helicase homolog, S. cerevisiae), and has LocusID: 1664. DDX12 is located at chromosome 12p13. TRIP11 encode thyroid hormone receptor interactor 11, and has LocusID: 9321. TRIP11 is located at chromosome 14q31-q32. CPS 263, or fragments thereof, also aligns to other regions in the human genome with 90-95% sequence identity.

CPS 264 corresponds to KIAA0410 which encodes KIAA0410 gene product. The gene has LocusID: 9818, and is located on chromosome 13 with reported cytogenetic location 13q12.12.

CPS 265 corresponds to PSMD3 which encodes proteasome (prosome, macropain) 26S subunit, non-ATPase, 3. The gene has LocusID: 5709, and is located on chromosome 17 with reported cytogenetic location 17q12.

CPS 266 corresponds to C1 QBP which encodes complement component 1, q subcomponent binding protein. The gene has LocusID: 708, and is located on chromosome 17 with reported cytogenetic location 17p13.3. The human complement subcomponent C1q associates with C1r and C1s to yield the first component of the serum complement system. The protein encoded by C1QBP gene is known to bind to the globular heads of C1q molecules and inhibit C1 activation. This protein has also been identified as the p32 subunit of pre-mRNA splicing factor SF2, as well as a hyaluronic acid-binding protein.

Nucleotides 58 to 1071 and 107 to 1037 of SEQ ID NO: 296 align to C1QBPP and an intron sequence of RYR3 with 79-84% sequence identity. C1QBPP encodes complement component 1, q subcomponent binding protein, pseudogene. It has LocusID: 54098, and is located at chromosome 21q21.1. RYR3 encodes ryanodine receptor 3. RYR3 has LocusID: 6263, and is located at chromosome 15q14q15.

In addition, nucleotides 1070 to 1227 of SEQ ID NO: 296 align to LOC221903 with 100% sequence identity. LOC221903 is a hypothetical gene supported by AF000974, BC004999, AF000974, BC021540, BC004249, AJ001902, AF025437, L40374, BC004999, AF025437, AK056773, BC002680, AK056773, BC004999, and BC002680. The gene is located at chromosome 7q11.1.

CPS 267 corresponds to OSR1 which encodes oxidative-stress responsive 1. The gene has LocusID: 9943, and is located on chromosome 3 with reported cytogenetic location 3p22-p21.3. Oxidative-stress responsive 1 gene has at least 18 exons and is located in the vicinity of three others genes— GOLGA4, ITGA9 and HYA22. These four genes are considered to be candidate tumor suppressors. Oxidative-stress responsive 1 protein has similarity to human Ste20/oxidant stress response kinase-1 and is thought to be involved in the response to oxidative stress. Oxidative-stress responsive 1 protein is a putative member of SOK (Ste20/oxidant stress response kinase) family, and can be activated by oxidative stress.

CPS 268 corresponds to CD44 which encodes CD44 antigen (homing function and Indian blood group system). The gene has LocusID: 960, and is located on chromosome 11 with reported cytogenetic location 11p13.

CPS 269 corresponds to CRADD which encodes CASP2 and RIPK1 domain containing adaptor with death domain. The gene has LocusID: 8738, and is located on chromosome 12 with reported cytogenetic location 12q21.33-q23.1. The gene product is an apoptotic adaptor molecule, and may function to couple CASP2 to the FasL/TNF receptor-interacting protein RIP.-

CPS 270 corresponds to CCRL2 which encodes chemokine (C-C motif) receptor-like 2. The gene has LocusID: 9034, and is located on chromosome 3 with reported cytogenetic location 3p21. This gene encodes a chemokine receptor-like protein, which is predicted to be a seven transmembrane protein and most closely related to CCR1. Chemokines and their receptors are believed to be critical for the recruitment of effector immune cells to the site of inflammation. CCRL2 gene is expressed at high levels in primary neutrophils and primary monocytes, and is further upregulated on neutrophil activation and during monocyte to macrophage differentiation. CCRL2 gene is mapped to the region where the chemokine receptor gene cluster is located. The gene product is a member of the G protein-coupled receptor family.

CPS 271 corresponds to KIAA0707 (THEA) which encodes thioesterase, adipose associated. The gene has LocusID: 26027, and is located on chromosome 1 with reported cytogenetic location 1p32.2.

CPS 272 corresponds to KIAA1113 (TRIM33) which encodes tripartite motif-containing 33. The gene has LocusID: 51592, and is located on chromosome 1 with reported cytogenetic location 1p13.1. The protein encoded by this gene is thought to be a transcriptional corepressor. The encoded protein is a member of the tripartite motif family. The tripartite motif includes three zinc-binding domains, a RING, a B-box type 1 and a B-box type 2, and a coiled-coil region. At least three alternatively spliced transcript variants for this gene have been described.

CPS 273 corresponds to a chromosomal region on chromosome 21. This region is referred to as UNK_AL050119. The region is located in an intron of TMEM1 which encodes transmembrane protein 1. TMEM1 has LocusID: 7109 with reported cytogenetic location 21q22.3. TMEM1 gene product is similar to sodium channel proteins.

CPS 274 corresponds to UNK_AF052115 (LOC151405) which is a hypothetical gene supported by AF052115. The gene has reported cytogenetic location 2q33.3. LOC151405 gene is located 3' to the polypeptide-coding sequence of ADAM23 which encodes disintegrin and metalloproteinase domain 23. ADAM23 has LocusID: 8745, and is located on chromosome 2 with reported cytogenetic location 2q33. ADAM23 gene product is a member of the ADAM protein family. Members of this family are membrane-anchored proteins structurally related to snake venom disintegrins, and have been implicated in a variety of biologic processes involving cell-cell and cell-matrix interactions, including fertilization, muscle development, and neurogenesis.

CPS 275 corresponds to MITF which encodes microphthalmia-associated transcription factor. The gene has LocusID: 4286, and is located on chromosome 3 with reported cytogenetic location 3p14.1-p12.3. MITF gene product contains both basic helix-loop-helix and leucine zipper structural features. MITF produces at least two alternate transcripts: the M-isoform expressed exclusively in melanocytes, and the A-isoform with a broader range of expression. Mutations in MITF may lead to Waardenburg syndrome.

CPS 276 corresponds to STAT3 which encodes signal transducer and activator of transcription 3 (acute-phase response factor). The gene has LocusID: 6774, and is located on chromosome 17 with reported cytogenetic location 17q21.

The protein encoded by this gene is a member of the STAT protein family. In response to cytokines and growth factors, STAT family members can be phosphorylated by the receptor associated kinases, and then form homo- or heterodimers that translocate to the cell nucleus where they act as transcription activators. The protein encoded by STAT3 gene can be activated through phosphorylation in response to various cytokines and growth factors including IFNs, EGF, IL5, IL6, HGF, LIF and BMP2. The encoded protein can mediate the expression of a variety of genes in response to cell stimuli, and thus plays a role in many cellular processes such as cell growth and apoptosis. The small GTPase Rac1 has been shown to bind and regulate the activity of this protein. PIAS3 protein is a specific inhibitor of this protein. Two alternatively spliced transcript variants encoding distinct isoforms have been described.

In addition, nucleotides 16 to 2787 of SEQ ID NO: 315 (L29277) have at least 95% sequence identity with STAT3. Therefore, SEQ ID NO: 315 (L29277), or the complement thereof, can be used to design probes/primers for detecting the expression of STAT3. Nucleotides 217 to 1502 of SEQ ID NO: 315 (L29277) have at least. 98% sequence identity with LOC254114. LOC254114 encodes a protein similar to signal transducer and activator of transcription 3 (acute-phase response factor). LOC254114 is located on chromosome 17.

CPS 277 corresponds to TPD52L2 which encodes tumor protein D52-like 2. The gene has LocusID: 7165, and is located on chromosome 20 with reported cytogenetic location 20q13.2-q13.3. The gene product is a member of the D52-like family of proteins, and may have a role in controlling cell proliferation. The gene product contains coiled-coil domains.

CPS 278 corresponds to a chromosomal region (referred to as UNK_AI732885). This chromosomal region is located in an intron of CG005 which encodes a hypothetical protein from BCRA2 region. CG005 has LocusID: 10443 with reported cytogenetic location 13q12-q13. CG005 gene product includes a region having low similarity to a region of rat 2',3'-cyclic nucleotide 3'-phosphodiesterase (Rn.31762).

CPS 279 corresponds to MAP3K8 which encodes mitogen-activated protein kinase kinase kinase 8. The gene has LocusID: 1326, and is located on chromosome 10 with reported cytogenetic location 10p11.2. This gene was identified by its oncogenic transforming activity in cells. The encoded protein is a member of the serine/threonine protein kinase family. This kinase can activate both the MAP kinase and JNK kinase pathways. This kinase was shown to activate IkappaB kinases, and thus induce the nuclear production of NF-kappaB. This kinase was also found to promote the production of TNF-alpha and IL-2 during T lymphocyte activation. Studies of a similar gene in rat suggested the direct involvement of this kinase in the proteolysis of NF-kappaB1, p105 (NFKB1). MAP3K8 gene may also utilize a downstream in-frame translation start codon, and thus produce an isoform containing a shorter N-terminus. The shorter isoform has been shown to display weaker transforming activity.

CPS 280 corresponds to NSP-CL (RTN4) which encodes reticulon 4. The gene has LocusID: 57142, and is located on chromosome 2 with reported cytogenetic location 2p14-p13. RTN4 gene overlaps LOC200512 on chromosome 2. LOC200512 encodes a protein similar to reticulon 4. LOC200512 has reported cytogenetic location 2p16.1.

CPS 281 corresponds to NRG1 which encodes neuregulin 1. The gene has LocusID: 3084, and is located at chromosome 8 with reported cytogenetic location 8p21-p12. Neuregulin 1 was originally identified as a 44-kD glycoprotein that interacts with the NEU/ERBB2 receptor tyrosine kinase to increase its phosphorylation on tyrosine residues. It is known that an extraordinary variety of different isoforms are produced from the NRG1 gene by alternative splicing. These isoforms include heregulins (HRGs), glial growth factors (GGFs) and sensory and motor neuron-derived factor (SMDF). They are tissue-specifically expressed and differ significantly in their structure. The HRG isoforms all contain immunoglobulin (Ig) and epidermal growth factor-like (EGF-like) domains. The GGF and GGF2 isoforms contain a kringle-like sequence plus Ig and EGF-like domains, and the SMDF isoform shares only the EGF-like domain with other isoforms. The receptors for all NRG1 isoforms are the ERBB family of tyrosine kinase transmembrane receptors. Through interaction with ERBB receptors, NRG1 isoforms may induce the growth and differentiation of epithelial, neuronal, glial, and other types of cells.

CPS 282 corresponds to RAB31 which encodes RAB31, member RAS oncogene family. The gene has LocusID: 11031, and is located on chromosome 18 with reported cytogenetic location 18p11.3. The gene product is a GTP-binding protein.

CPS 282 also aligns to LOC12414 and LOC200972 with 83% sequence identity. LOC124146 has reported cytogenetic location 16q11.2, and encodes a protein similar to GTP-binding protein Rab0. LOC200972 is located on chromosome 3, and also encodes a protein similar to GTP-binding protein Rab0.

CPS 283 corresponds to MEF2D which encodes MADS box transcription enhancer factor 2, polypeptide D (myocyte enhancer factor 2D). The gene has LocusID: 4209, and is located on chromosome 1 with reported cytogenetic location 1q12-q23. The gene product is a member of the MADS box family of transcription factors, and may regulate muscle-specific and mitogen-inducible genes.

CPS 285 corresponds to CXCR4 which encodes chemokine (C—X—C motif) receptor 4. The gene has LocusID: 7852, and is located on chromosome 2 with reported cytogenetic location 2q21. CXC chemokine receptor (fusin) is a G protein-coupled receptor which can mediate intracellular calcium flux.

CPS 286 corresponds to M9 which encodes muscle specific gene. The gene has LocusID: 27335, and is located on chromosome 19 with reported cytogenetic location 19q13.2. Nucleotides 109 to 858 of SEQ ID NO: 318 have 88% sequence identity with LOC134505 which is similar to muscle specific gene. LOC134505 is located on chromosome 5 with reported cytogenetic location 5q15. Nucleotides 100 to 856 of SEQ ID NO: 318 also align to a chromosomal region on chromosome 4 with about 85% sequence identity. The chromosomal region encompasses LOC152771 which is similar to PRO1474. LOC152771 has reported cytogenetic location 4q26. In addition, nucleotides 140 to 799 of SEQ ID NO: 318 align to LOC131480 with about 84% sequence identity. LOC131480 encodes a protein similar to PRO1474, and has reported cytogenetic location 3p24.1.

CPS 287 corresponds to FAU which encodes Finkel-Biskis-Reilly murine sarcoma virus (FBR-MuSV) ubiquitously expressed (fox derived); ribosomal protein S30. The gene has LocusID: 2197, and is located on chromosome 11 with reported cytogenetic location 11q13. This gene is the cellular homolog of the fox sequence in the Finkel-Biskis-Reilly murine sarcoma virus (FBR-MuSV). It encodes a fusion protein consisting of the ubiquitin-like protein fubi at the N terminus and ribosomal protein S30 at the C terminus. It has been proposed that the fusion protein is post-translationally processed to generate free fubi and free ribosomal protein S30. Fubi is a member of the ubiquitin family, and ribosomal protein S30 belongs to the S30E family of ribosomal proteins. Pseudogenes derived from this gene are present in the genome.

SEQ ID NO: 319 also aligns to FAUP1 with about 92% sequence identity. FAUP1 encodes FBR-MuSV-associatedu ubiquitously expressed (fox derived) pseudogene 1. The gene has LocusID: 140623, and is located on chromosome 18. Nucleotides 57 to 351 of SEQ ID NO: 319 have about 84% sequence identity with LOC151661. LOC151661 encodes a protein similar to ubiquitin-like/S30 ribosomal fusion protein. LOC151661 has reported cytogenetic location 3q27.2. In addition, nucleotides 454 to 490 of SEQ ID NO: 319 align to an intron sequence of RHOBTB1 with 97% sequence identity. RHOBTB1 encodes Rho-related BTB domain containing 1, and has LocusID: 9886 with reported cytogenetic location 10q22.1.

CPS 288 corresponds to RPS6 which encodes ribosomal protein S6. The gene has LocusID: 6194, and is located on chromosome 9 with reported cytogenetic location 9p21. This gene encodes a cytoplasmic ribosomal protein that is a component of the 40S subunit in ribosome. The encoded protein belongs to the S6E family of ribosomal proteins. It is the major substrate of protein kinases in the ribosome, with subsets of five G terminal serine residues phosphorylated by different protein kinases. It is reported that phosphorylation can be induced by a wide range of stimuli, including growth factors, tumor-promoting agents, and mitogens. Dephosphorylation occurs at growth arrest. The encoded protein may contribute to the control of cell growth and proliferation through the selective translation of particular classes of mRNA. This gene has multiple processed pseudogenes dispersed through the genome.

Fragments of SEQ ID NO: 320 align to various chromosomal regions with about 80-97% sequence identity. These chromosomal regions include, for example, LOC205865, LOC137397, LOC253482, and an intron sequence of GCDH. LOC205865 encodes a protein similar to ribosomal protein S6. The gene has reported cytogenetic location 4q21.22. LOC137397 encodes a protein similar to Rim2 protein, and is located at chromosome 8q22.3. LOC253482 encodes a protein similar to ribosomal protein S6, and is located on chromosome 9. GCDH encodes glutaryl-Coenzyme A dehydrogenase. GCDH has LocusID: 2639, and is located at chromosome 19p13.2.

CPS 289 corresponds to BAG5 which encodes BCL2-associated athanogene 5. The gene has LocusID: 9529, and is located on chromosome 14 with reported cytogenetic location 14q32.33. The protein encoded by this gene is a member of the BAG1-related protein family. BAG1 is believed to be an anti-apoptotic protein that may function through interactions with a variety of cell apoptosis and growth related proteins including BCL-2, Raf-protein kinase, steroid hormone receptors, growth factor receptors and members of the heat shock protein 70 kDa family. The protein encoded by BAG5 gene contains a BAG domain near the C-terminus, which may bind and inhibit the chaperone activity of Hsc70/Hsp70.

Nucleotides 3913 to 4117 of SEQ ID NO: 321 show 82% sequence identity with an intron sequence of DNAH11. DNAH11 encodes dynein, axonemal, heavy polypeptide 11. The gene has LocusID: 8701, and is reportedly located on chromosome 7p21.

CPS 290 corresponds to UNK_AL022721 (RPL10A) which encodes ribosomal protein L10a. RPL10A has LocusID: 4736, and is located on chromosome 6 with reported cytogenetic location 6p21.3-p21.2. The gene product is a component of the large 60S ribosomal subunit.

CPS 290 also has 96% sequence identity with LOC253986 and LOC137107, both of which encode proteins similar to ribosomal protein L10a. LOC253986 is located on chromosome 8, and LOC137107 is located at chromosome 8p11.23. In addition, CPS 290 has about 90-96% sequence identity with intron sequences of PTPRG, BST1, and MARK3. PTPRG encodes protein tyrosine phosphatase, receptor type, G. PTPRG has LocusID: 5793, and is located at chromosome 3p21-p14. BST1 encodes bone marrow stromal cell antigen 1, and has LocusID: 683 with reported cytogenetic location 4p15. MARK3 encodes MAP/microtubule affinity-regulating kinase 3, and has LocusID: 4140 with reported cytogenetic location 14q32.3. CPS 290 aligns to LOC138030 with 84% sequence identity. LOC138030 encodes a protein similar to ribosomal protein L10a, and is located at chromosome 8p21.3.

CPS 290 (SEQ ID NO: 329) is a spliced product of the complement of nucleotides 26623 to 27200 of SEQ ID NO: 322. Blast search against the Entrez human genome database shows that SEQ ID NO: 322 has 100% sequence identity with a chromosomal region on chromosome 6. This chromosomal region is located within Genomic Locus NT_007592, and includes the following genes: TEAD3, RPL10A, FANCE, LOC221485, and LOC221486. TEAD3 encodes TEA domain family member 3, and has LocusID: 7005. RPL10A encodes ribosomal protein L10a, and has LocusID: 4736. FANCE encodes Fanconi anemia, complementation group E, and has LocusID: 2178. LOC221485 encodes a protein similar to dJ109F14.3 (PUTATIVE ZNF127 LIKE protein). LOC221486 encodes a protein similar to Peroxisome proliferator activated receptor beta (PPAR-beta) (PPAR-delta) (Nuclear hormone receptor 1) (NUC1) (NUCI). SEQ ID NO: 322 aligns to the protein-coding strand of TEAD3, while aligning to the non-protein-coding strands of RPL10A, FANCE, LOC221485, and LOC221486.

Fragments of SEQ ID NO: 322 show various degrees of sequence identity with a plurality of chromosomal regions through the human genome.

CPS 291 corresponds to DKZP586E0820 (PKD2) which encodes protein kinase D2. The gene has LocusID: 25865, and is located on chromosome 19 with reported cytogenetic location 19q13.2. The gene product is similar to a region of mu isoforms of protein kinase C, and may function to mediate protein-protein and protein-lipid interaction. The gene product contains a kinase domain and a pleckstrin homology (PH) domain.

CPS 292 corresponds to NONO which encodes non-POU domain containing, octamer-binding. The gene has LocusID: 4841, and is located on chromosome X with reported cytogenetic location Xq13.1. The gene product is a nuclear protein which contains RNA recognition motifs.

SEQ ID NO: 324 also aligns to LOC146455 with about 95-96% sequence identity. LOC146455 encodes a protein similar to 54 kDa nuclear RNA- and DNA-binding protein (p54(nrb)) (p54nrb) (55 kDa nuclear protein) (NMT55) (Non-POU domain-containing octamer-binding protein) (DNA-binding P52/P100 complex, 52 kDa subunit). LOC146455 is located at chromosome 16q22.3. In addition, nucleotides 514 to 2591 of SEQ ID NO: 324 have about 84-85% sequence identity with a chromosomal region which overlaps LOC130867. LOC130867 encodes a protein similar to ribosomal protein S12 (40S ribosomal protein S12), and is located at chromosome 2p15.

CPS 293 corresponds to UNK_AI743507 (ZFR) which encodes zinc finger RNA binding protein. ZFR has LocusID: 51663, and is located on chromosome 5 with reported cytogenetic location 5p13.2.

CPS 293 also shows 92% sequence identity with LOC119355 which encodes a protein similar to M-phase phosphoprotein homolog; likely ortholog of mouse zinc finger protein Zfr. LOC119355 has reported cytogenetic location 10q23.33. In addition, CPS 293 has 94-96% sequence identity with a chromosomal region on chromosome 1. The chromosomal region is close to TSNAX which encodes translin-associated factor X and has LocusID: 7257 and cytogenetic location 1q42.1. Nucleotides 292 to 399 of CPS 293 have about 92% sequence identity with a chromosomal region on chromosome 1.

CPS 294 corresponds to MAPKAPK5 which encodes mitogen-activated protein kinase-activated protein kinase 5. The gene has LocusID: 8550, and is located on chromosome 12 with reported cytogenetic location 12q24.12. The protein encoded by this gene is a member of the serine/threonine kinase family. In response to cellular stress and proinflammatory cytokines, this kinase may be activated through its phosphorylation by MAP kinases including MAPK1/ERK, MAPK14/p38alpha, and MAPK11/p38-beta. At least two alternately spliced transcript variants of this gene encoding distinct isoforms have been reported.

CPS 295 corresponds to UNK_U79297 (LOC157567) which encodes a protein similar to hypothetical protein MGC25673. LOC157567 is reportedly located at chromosome 8q23.1.

The significance of the RCC disease genes listed in Table 4 can be estimated using a relative class separation metric according to the supervised classification of RCC versus disease-free. See Golub, et al., Science, 286: 531-537 (1999), and Slonim, et al., Procs. of the Fourth Annual International Conference on Computational Molecular Biology, Tokyo, Japan, April 8-11, p263-272 (2000). A neighborhood analysis can then be performed to determine the significance of the measured correlations. For instance, this method can randomly permute the 65 total sample (45 RCC patients and 20 disease-free humans) into two groups of 45 and 20 samples each and then rank the genes with the highest measures of correlation in the 100 randomized sets of samples. This analysis shows that a majority of RCC disease genes identified in the present invention possess measures or correlation above the 1% significant level compared to randomly permuted class vectors.

The biological mechanisms underlying the differential expression patterns of the RCC disease genes in the peripheral blood are not fully understood. The differential expression patterns may be attributed to the altered gene expression patterns in shed RCC tumor cells in the peripheral blood. For instance, Table 5 shows that a subset of the RCC disease genes are also differentially expressed in RCC tumor cells compared to PBMCs of disease-free humans. The differential expression pattern may also be caused by immunogenic reactions induced by RCC tumors. In one experiment, peripheral blood mononuclear cells are isolated from disease-free humans and then treated with phytohemagglutinin (PHA). PHA stimulation ex vivo appears to recapitulate the differential expression pattern of a significant number of the RCC disease genes of this invention, as illustrated in Table 5. This suggests that the differential expression patterns of some RCC disease genes in the peripheral blood may arise from an activation of leukocytes in vivo.

Table 5 further identifies a substantial subset of RCC disease genes that are differentially expressed in patients with end-stage renal failure. Therefore, the differential expression patterns of this subset of RCC disease genes in the peripheral blood could be due to alterations in leukocytes in response to renal dysfunction in RCC patients.

TABLE 5

RCC Disease Genes Differentially Expressed Under Other Conditions

| RCC Disease Gene | Entrez Accession No. | Differentially Expressed in: (compared to disease-free PBMCs) |
|---|---|---|
| IL1R1 | M27492 | Ex vivo PHA-stimulated PBMCs |
| CSF2 | M13207 | Ex vivo PHA-stimulated PBMCs |
| IL1B | | Ex vivo PHA-stimulated PBMCs |
| Tubulin, Beta | AF141349 | Ex vivo PHA-stimulated PBMCs |
| BASP1 | AA135683 | Ex vivo PHA-stimulated PBMCs |
| SIAH2 | U76248 | Ex vivo PHA-stimulated PBMCs |
| GSPT1 | X17644 | Ex vivo PHA-stimulated PBMCs |
| SCYA2 | M28225 | Ex vivo PHA-stimulated PBMCs |
| BCL2L1 | Z23115 | Ex vivo PHA-stimulated PBMCs |
| BAG1 | Z35491 | Ex vivo PHA-stimulated PBMCs |
| PAI2 | Y00630 | Ex vivo PHA-stimulated PBMCs |
| HPGD | X82460 | Ex vivo PHA-stimulated PBMCs |
| CTSL | X12451 | Ex vivo PHA-stimulated PBMCs |
| IL6 | X04430 | Ex vivo PHA-stimulated PBMCs |
| TUBB | X79535 | Ex vivo PHA-stimulated PBMCs |
| SCYA7 | X72308 | Ex vivo PHA-stimulated PBMCs |
| DRD2 | X51362 | Ex vivo PHA-stimulated PBMCs |
| SCYA2 | M26683 | Ex vivo PHA-stimulated PBMCs |
| FABP5 | M94856 | Ex vivo PHA-stimulated PBMCs/ RCC Tumor Tissue |
| SCYA20 | U64197 | Ex vivo PHA-stimulated PBMCs/ RCC Tumor Tissue |
| ADM | D14874 | Ex vivo PHA-stimulated PBMCs/ RCC Tumor Tissue/Renal Failure PBMCs |
| COPEB | AF001461 | Ex vivo PHA-stimulated PBMCs/ RCC Tumor Tissue/Renal Failure PBMCs |
| AQP9 | AB008775 | Ex vivo PHA-stimulated PBMCs/ Renal Failure PBMCs |
| PTGS2 | U04636 | Ex vivo PHA-stimulated PBMCs/ Renal Failure PBMCs |
| STIP1 | M86752 | Ex vivo PHA-stimulated PBMCs/ Renal Failure PBMCs |
| SOD2 | X07834 | Ex vivo PHA-stimulated PBMCs/ Renal Failure PBMCs |
| PDXK | U89606 | Ex vivo PHA-stimulated PBMCs/ Renal Failure PBMCs |
| IL1RN | X52015 | Ex vivo PHA-stimulated PBMCs/ Renal Failure PBMCs |
| ANXA5 | U05770 | Ex vivo PHA-stimulated PBMCs/ Renal Failure PBMCs |
| IFIT4 | AF026939 | Ex vivo PHA-stimulated PBMCs/ Renal Failure PBMCs |
| IL1B | M15330 | Ex vivo PHA-stimulated PBMCs/ Renal Failure PBMCs |
| GRO1 | X54489 | Ex vivo PHA-stimulated PBMCs/ Renal Failure PBMCs |
| PLAUR | X74039 | Ex vivo PHA-stimulated PBMCs/ Renal Failure PBMCs |
| NP | X00737 | Ex vivo PHA-stimulated PBMCs/ Renal Failure PBMCs |
| FCGR3B | X16863 | RCC Tumor Tissue |
| UNK_M62896 | M62896 | RCC Tumor Tissue |
| FN1 | X02761 | RCC Tumor Tissue |
| HMOX1 | Z82244 | RCC Tumor Tissue |
| ITGA7 | AF032108 | RCC Tumor Tissue |
| DGCR5 | X91348 | RCC Tumor Tissue |
| CBP2 | D83174 | RCC Tumor Tissue |
| UNK_AL049250 | AL049250 | RCC Tumor Tissue |
| SLC1A4 | AA978353 | RCC Tumor Tissue |
| MMP9 | J05070 | RCC Tumor Tissue/Renal Failure PBMCs |
| SLC16A3 | U81800 | RCC Tumor Tissue/Renal Failure PBMCs |
| LILRB3 | AF025533 | RCC Tumor Tissue/Renal Failure PBMCs |
| FCGR1A | M63835 | RCC Tumor Tissue/Renal Failure PBMCs |
| LHFPL2 | D86961 | RCC Tumor Tissue/Renal Failure PBMCs |
| PLEC1 | U53204 | RCC Tumor Tissue/Renal Failure PBMCs |
| S100A11 | D38583 | RCC Tumor Tissue/Renal Failure PBMCs |
| SPOP | AJ000644 | RCC Tumor Tissue/Renal Failure PBMCs |
| CCR1 | D10925 | RCC Tumor Tissue/Renal Failure PBMCs |
| TLR2 | AF051152 | RCC Tumor Tissue/Renal Failure PBMCs |
| KIAA0750 | AB018293 | RCC Tumor Tissue/Renal Failure PBMCs |
| CDC34 | L22005 | Renal Failure PBMCs |
| POLR2J | L37127 | Renal Failure PBMCs |
| ETS2 | J04102 | Renal Failure PBMCs |
| MAD | L06895 | Renal Failure PBMCs |
| GPR3 | L32831 | Renal Failure PBMCs |
| PIP5K1C | AB011161 | Renal Failure PBMCs |
| PRF1 | M28393 | Renal Failure PBMCs |
| PSMA7 | AF054185 | Renal Failure PBMCs |
| INPP4A | U96919 | Renal Failure PBMCs |
| TCFL1 | D43642 | Renal Failure PBMCs |
| DGAT | AF059202 | Renal Failure PBMCs |
| S100P | AA131149 | Renal Failure PBMCs |
| DOC-1R | AF089814 | Renal Failure PBMCs |
| C8FW | AJ000480 | Renal Failure PBMCs |
| PDI2 | AB023211 | Renal Failure PBMCs |
| GEF-2 | AI565760 | Renal Failure PBMCs |

TABLE 5-continued

RCC Disease Genes Differentially Expressed Under Other Conditions

| RCC Disease Gene | Entrez Accession No. | Differentially Expressed in: (compared to disease-free PBMCs) |
|---|---|---|
| TNNT1 | M19309 | Renal Failure PBMCs |
| BSG | X64364 | Renal Failure PBMCs |
| IL17R | U58917 | Renal Failure PBMCs |
| HK3 | U51333 | Renal Failure PBMCs |
| RALBP1 | L42542 | Renal Failure PBMCs |
| RNASE2 | X55988 | Renal Failure PBMCs |
| TPM1 | M19267 | Renal Failure PBMCs |
| BLVRB | D32143 | Renal Failure PBMCs |
| APS | AB000520 | Renal Failure PBMCs |
| PPARD | L07592 | Renal Failure PBMCs |
| NFE2 | S77763 | Renal Failure PBMCs |
| IL1RAP | AB006537 | Renal Failure PBMCs |
| ETS2 | AF017257 | Renal Failure PBMCs |
| S100A12 | D83664 | Renal Failure PBMCs |
| CD9 | M38690 | Renal Failure PBMCs |
| ENIGMA | L35240 | Renal Failure PBMCs |
| HAGH | X90999 | Renal Failure PBMCs |
| NCF1 | M55067 | Renal Failure PBMCs |
| FLOT1 | AF089750 | Renal Failure PBMCs |
| ITGA2B | M34480 | Renal Failure PBMCs |
| FKBP8 | L37033 | Renal Failure PBMCs |
| DUSP6 | AB013382 | Renal Failure PBMCs |
| CBFA2T3 | AB010419 | Renal Failure PBMCs |

C. Other Solid Tumor Disease Genes

The methodologies described in subsection B can be easily adapted to the identification of other solid tumor disease genes. These solid tumor disease genes are differentially expressed in the peripheral blood or PBMCs of solid tumor patients compared to disease-free humans.

In one embodiment, the genechip expression data derived from PBMC-enriched peripheral blood samples of RCC, prostate cancer, head/neck cancer and disease-free humans is collected, compared and analyzed using a multi-class correlation metric. The multi-class correlation metric can identify and rank the genes mostly highly correlated with each class of the peripheral blood gene expression profiles. Suitable multi-class correlation metrics include, but are not limited to, the GeneCluster 2 software provided by MIT Center for Genome Research at Whitehead Institute (Cambridge, Mass.). The GeneCluster 2 software has supervised classification, gene selection and permutation test functions. It includes algorithms for building and testing supervised models using weighted voting and k-nearest neighbors algorithms.

In one example, a 20-gene set is selected using 70% of the expression profiles as a training set. These 20 multi-class classifier genes are listed in Table 10. Each of these 20 genes has a differential expression pattern in the peripheral blood of all three classes of solid tumor patients (i.e., RCC, prostate cancer and head/neck cancer) as compared to disease-free humans. The gene set has over 89% prediction accuracy for each remaining profile. Other gene sets with high predication accuracy for RCC, prostate cancer, head/neck cancer and disease-free can be similarly obtained.

In another embodiment, a multi-class correlation metric is used to identify genes capable of predicting solid tumor versus solid tumor-free, regardless of the particular type of the solid tumor. The peripheral blood gene expression profiles from RCC, prostate cancer, head/neck cancer, and disease-free humans are analyzed using multi-class comparison. A 19-gene set is selected using 70% of the total samples as a training set. The gene set thus selected is listed in Table 11. Each gene in the gene set is differentially expressed in the peripheral blood of all three types of solid tumor patients (RCC, prostate cancer, and head/neck cancer) as compared to disease-free humans. This 19-gene set is capable of accurately predicting solid tumor versus solid tumor-free for the remaining expression profiles. Other gene sets with high prediction accuracy for solid tumor versus solid tumor-free can be similarly obtained.

D. Detecting RCC, RCC-Free, Solid Tumor and/or Solid Tumor-Free

The RCC disease genes identified in Table 4 can be used to detect RCC, RCC-free, solid tumors, and/or solid tumor-free in a human subject with unknown disease status. For instance, if the expression patterns of one or more RCC disease genes in the peripheral blood sample of the human subject are not substantially different from the corresponding expression patterns in disease-free humans, then it is suggestive that the human subject under diagnosis is RCC-free. Conversely, if the expression patterns of one or more RCC disease genes in the human subject are substantially different from the corresponding expression patterns in disease-free humans (e.g., gene expression levels in the human subject are substantially higher or lower than those in disease-free humans), then it is suggestive that the human subject may be infected with RCC (or other solid tumors, depending on the genes used in the diagnosis). Algorithms, such as the weighted voting programs, can be used to facilitate the diagnosis. In addition, other clinical evidence can be combined with the gene-based test to reduce the risk of false diagnosis. Similar approaches can be used to predict the presence or absence of other solid tumors such as prostate cancer and head/neck caner.

Diagnostic or screening methods based on differentially expressed gene products are well known in the art. In accordance with one aspect of the present invention, the differential expression patterns of RCC disease genes can be determined by measuring the levels of RNA transcripts of these genes in peripheral blood samples. Suitable methods for this purpose include, but are not limited to, RT-PCT, Northern Blot, in situ hybridization, Southern Blot, slot-blotting, nuclease protection assay and polynucleotide arrays. The peripheral blood samples can be either whole blood, or blood samples containing enriched PBMCs.

In general, RNA isolated from peripheral blood samples can be amplified to cDNA or cRNA before detection and/or quantitation. The isolated RNA can be either total RNA or mRNA. The RNA amplification can be specific or non-specific. Suitable amplification methods include, but are not limited to, reverse transcriptase PCR, isothermal amplification, ligase chain reaction, and Qbeta replicase. The amplified nucleic acid products can be detected and/or quantitated through hybridization to labeled probes.

Amplification primers or hybridization probes for an RCC disease gene can be prepared from the gene sequence or its corresponding CPS using methods well known in the art. Gene sequences suitable for this purpose include, but are not limited to, exons, introns, or the 3' or 5' untranslated regions, or any combination thereof. In one embodiment, the probes or primers are designed based on the sequence in or near the 3' protein-coding region of the RCC disease gene. For instance, the nucleotide sequence encoding the last 100 to 300 amino acid residues in the C-terminus region of the RCC disease gene product can be selected to design probes or primers. In the case that the genomic location(s) of the RCC disease gene has not been determined or that the gene may correspond to multiple genomic loci, the probes/primers can be designed based on the CPS of the gene, or the oligonucleotide probes on the HG-U95Av2 gene chip that was used for the identification of the gene.

Table 4 lists sequences suitable for making probes/primers for the detection of their corresponding RCC disease genes. Examples of suitable oligonucleotide probes/primers are listed in ATTACHMENT A.

In one embodiment, each probe/primer comprises at least 15 nucleotides. For instance, each probe can comprise at least 20, 25, 50, 75, 100, 125, 150, 175, 200, 225, 250, 275, 300, 325, 350, 400 or more nucleotides. Preferably, each probe/primer has relatively high sequence complexity and does not have any ambiguous residue (undetermined "n" residues). The probes/primers preferably can hybridize to the target gene, including its RNA transcripts, under stringent or highly stringent conditions.

In another embodiment, the probes/primers for a gene are selected from regions which significantly diverge from the sequences of other genes. Such regions can be determined by checking the probe/primer sequences against a human genome sequence database, such as the Entrez database at the NCBI. One algorithm suitable for this purpose is the BLAST algorithm. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. These initial neighborhood word hits act as seeds for initiating searches to find longer HSPs containing them. The word hits are then extended in both directions along each sequence to increase the cumulative alignment score. Cumulative scores are calculated using, for nucleotide sequences, the parameters M (reward score for a pair of matching residues; always >0) and N (penalty score for mismatching residues; always <0). The BLAST algorithm parameters W, T, and X determine the sensitivity and speed of the alignment. These parameters can be adjusted for different purposes, as appreciated by one of ordinary skill in the art.

In a preferred embodiment, quantitative RT-PCR (such as TaqMan, ABI) is used for detecting and comparing the levels of RNA transcripts of the RCC disease genes in peripheral blood samples. Quantitative RT-PCR involves reverse transcription (RT) of RNA to cDNA followed by relative quantitative PCR (RT-PCR).

In PCR, the number of molecules of the amplified target DNA increases by a factor approaching two with every cycle of the reaction until some reagent becomes limiting. Thereafter, the rate of amplification becomes increasingly diminished until there is not an increase in the amplified target between cycles. If one plots a graph on which the cycle number is on the X axis and the log of the concentration of the amplified target DNA is on the Y axis, one observes that a curved line of characteristic shape is formed by connecting the plotted points. Beginning with the first cycle, the slope of the line is positive and constant. This is said to be the linear portion of the curve. After some reagent becomes limiting, the slope of the line begins to decrease and eventually becomes zero. At this point the concentration of the amplified target DNA becomes asymptotic to some fixed value. This is said to be the plateau portion of the curve.

The concentration of the target DNA in the linear portion of the PCR is proportional to the starting concentration of the target before the PCR was begun. By determining the concentration of the PCR products of the target DNA in PCR reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundances of the specific mRNA from which the target sequence was derived may be determined for the respective tissues or cells. This direct proportionality between the concentration of the PCR products and the relative mRNA abundances is true in the linear range portion of the PCR reaction.

The final concentration of the target DNA in the plateau portion of the curve is determined by the availability of reagents in the reaction mix and is independent of the original concentration of target DNA. Therefore, the sampling and quantifying of the amplified PCR products preferably are carried out when the PCR reactions are in the linear portion of their curves. In addition, relative concentrations of the amplifiable cDNAs preferably are normalized to some independent standard, which may be based on either internally existing RNA species or externally introduced RNA species. The abundance of a particular mRNA species may also be determined relative to the average abundance of all mRNA species in the sample.

In one embodiment, the PCR amplification utilizes internal PCR standards that are approximately as abundant as the target. This strategy is effective if the products of the PCR amplifications are sampled during their linear phases. If the products are sampled when the reactions are approaching the plateau phase, then the less abundant product may become relatively over-represented. Comparisons of relative abundances made for many different RNA samples, such as is the case when examining RNA samples for differential expression, may become distorted in such a way as to make differences in relative abundances of RNAs appear less than they actually are. This can be improved if the internal standard is much more abundant than the target. If the internal standard is more abundant than the target, then direct linear comparisons may be made between RNA samples.

A problem inherent in clinical samples is that they are of variable quantity and/or quality. This problem can be overcome if the RT-PCR is performed as a relative quantitative RT-PCR with an internal standard in which the internal standard is an amplifiable cDNA fragment that is larger than the target cDNA fragment and in which the abundance of the mRNA encoding the internal standard is roughly 5-100 fold higher than the mRNA encoding the target. This assay measures relative abundance, not absolute abundance of the respective mRNA species.

In another embodiment, the relative quantitative RT-PCR uses an external standard protocol. Under this protocol, the PCR products are sampled in the linear portion of their amplification curves. The number of PCR cycles that are optimal for sampling can be empirically determined for each target cDNA fragment. In addition, the reverse transcriptase products of each RNA population isolated from the various samples can be normalized for equal concentrations of amplifiable cDNAs. While empirical determination of the linear range of the amplification curve and normalization of cDNA preparations are tedious and time-consuming processes, the resulting RT-PCR assays may, in certain cases, be superior to those derived from a relative quantitative RT-PCR with an internal standard.

Nucleic acid arrays can also be used to detect and compare the differential expression patterns of RCC disease genes in peripheral blood samples. The probes suitable for detecting the corresponding RCC disease genes can be stably attached to known discrete regions on a solid substrate. As used herein, a probe is "stably attached" to a discrete region if the probe maintains its position relative to the discrete region during the hybridization and the subsequent washes. Construction of nucleic acid arrays is well known in the art. Suitable substrates for making polynucleotide arrays include, but are not limited to, membranes, films, plastics and quartz wafers.

A nucleic acid array of the present invention can comprise at least 2, 5, 10, 15, 20, 25, 30, 35, 40, 45, 50, 60, 70, 80, 90, 100, 150, 200, 250 or more different polynucleotide probes, each different probe capable of hybridizing to a different respective RCC disease gene. Multiple probes for the same gene can be used on a single nucleic acid array. Examples of probes suitable for this invention are listed in ATTACHMENT A. Probes for other disease genes can also be included in the nucleic acid array of this invention. The probe density on the array can be in any range. For instance, the density may be 50, 100, 200, 300, 400, 500 or more probes/$cm^2$.

In one embodiment, nuclease protection assays are used to quantify RNAs derived from the peripheral blood samples. There are many different versions of nuclease protection assays known to those practiced in the art. The common characteristic that these nuclease protection assays is that they involve hybridization of an antisense nucleic acid with the RNA to be quantified. The resulting hybrid double-stranded molecule is then digested with a nuclease that digests single-stranded nucleic acids more efficiently than double-stranded molecules. The amount of antisense nucleic acid that survives digestion is a measure of the amount of the target RNA species to be quantified. An example of a nuclease protection assay that is commercially available is the RNase protection assay manufactured by Ambion, Inc. (Austin, Tex.).

The above-described methods can also be used to determine the levels of RNA species in the peripheral blood that are capable of hybridizing to the CPSs listed in CPS-Table-2. The levels of these RNA species in the peripheral blood can be indicative as to whether a human subject has RCC or is RCC-free.

In accordance with another aspect of the present invention, the differential expression patterns of RCC disease genes can be determined by measuring the levels of polypeptides encoded by these genes in peripheral blood. Methods suitable for this purpose include, but are not limited to, immunoassays such as ELISA, RIA, FACS, dot blot, Western Blot, immunohistochemistry, and antibody-based radioimaging. Protocols for carrying out these immunoassays are well known in the art. Other methods such as 2-dimensional SDS-polyacrylamide gel electrophoresis can also be used.

One exemplary method suitable for detecting the levels of target proteins in peripheral blood samples is ELISA. In an exemplifying ELISA, antibodies capable of binding to the target proteins encoded by one or more RCC disease genes are immobilized onto a selected surface exhibiting protein affinity, such as wells in a polystyrene or polyvinylchloride microtiter plate. Then, peripheral blood samples to be tested are added to the wells. After binding and washing to remove non-specifically bound immunocomplexes, the bound antigen(s) can be detected. Detection can be achieved by the addition of a second antibody which is specific for the target proteins and is linked to a detectable label. Detection may also be achieved by the addition of a second antibody, followed by the addition of a third antibody that has binding affinity for the second antibody, with the third antibody being linked to a detectable label. Before being added to the microtiter plate, cells in the peripheral blood samples can be lysed using various methods known in the art. Proper extraction procedures can be used to separate the target proteins from potentially interfering substances.

In another exemplifying ELISA, the peripheral blood samples suspected of containing the target proteins are immobilized onto the well surface and then contacted with the antibodies of the invention. After binding and washing to remove non-specifically bound immunocomplexes, the bound antigen is detected. Where the initial antibodies are linked to a detectable label, the immunocomplexes can be detected directly. The immunocomplexes can also be detected using a second antibody that has binding affinity for the first antibody, with the second antibody being linked to a detectable label.

Another exemplary ELISA involves the use of antibody competition in the detection. In this ELISA, the target proteins are immobilized on the well surface. The labeled antibodies are added to the well, allowed to bind to the target proteins, and detected by means of their labels. The amount of the target proteins in an unknown sample is then determined by mixing the sample with the labeled antibodies before or during incubation with coated wells. The presence of the target proteins in the unknown sample acts to reduce the amount of antibody available for binding to the well and thus reduces the ultimate signal.

Different ELISA formats can have certain features in common, such as coating, incubating or binding, washing to remove non-specifically bound species, and detecting the bound immunocomplexes. For instance, in coating a plate with either antigen or antibody, the wells of the plate can be incubated with a solution of the antigen or antibody, either overnight or for a specified period of hours. The wells of the plate are then washed to remove incompletely adsorbed material. Any remaining available surfaces of the wells are then "coated" with a nonspecific protein that is antigenically neutral with regard to the test samples. Examples of these nonspecific proteins include bovine serum albumin (BSA), casein and solutions of milk powder. The coating allows for blocking of nonspecific adsorption sites on the immobilizing surface and thus reduces the background caused by nonspecific binding of antisera onto the surface.

In ELISAs, a secondary or tertiary detection means can also be used. After binding of a protein or antibody to the well, coating with a non-reactive material to reduce background, and washing to remove unbound material, the immobilizing surface is contacted with the control and/or clinical or biological sample to be tested under conditions effective to allow immunocomplex (antigen/antibody) formation. These conditions may include, for example, diluting the antigens and antibodies with solutions such as BSA, bovine gamma globulin (BGG) and phosphate buffered saline (PBS)/Tween and incubating the antibodies and antigens at room temperature for about 1 to 4 hours or at 49C overnight. Detection of the immunocomplex then requires a labeled secondary binding ligand or antibody, or a secondary binding ligand or antibody in conjunction with a labeled tertiary antibody or third binding ligand.

Following all incubation steps in an ELISA, the contacted surface can be washed so as to remove non-complexed material. For instance, the surface may be washed with a solution such as PBS/Tween, or borate buffer. Following the formation of specific immunocomplexes between the test sample and the originally bound material, and subsequent washing, the occurrence of the amount of immunocomplexes can be determined.

To provide a detecting means, the second or third antibody can have an associated label to allow detection. In one embodiment, the label is an enzyme that generates color development upon incubating with an appropriate chromogenic substrate. Thus, for example, one may contact and incubate the first or second immunocomplex with a urease, glucose oxidase, alkaline phosphatase or hydrogen peroxidase-conjugated antibody for a period of time and under conditions that favor the development of further immunocomplex formation (e.g., incubation for 2 hours at room temperature in a PBS-containing solution such as PBS-Tween).

After incubation with the labeled antibody, and subsequent to washing to remove unbound material, the amount of label is quantified, e.g., by incubation with a chromogenic substrate such as urea and bromocresol purple or 2,2'-azido-di-(3-ethyl)-benzhiazoline-6-sulfonic acid (ABTS) and $H_2O_2$, in the case of peroxidase as the enzyme label. Quantitation can be achieved by measuring the degree of color generation, e.g., using a spectrophotometer.

Another method suitable this invention is RIA (radioimmunoassay). An exemplary RIA is based on the competition between radiolabeled-polypeptides and unlabeled polypeptides for binding to a limited quantity of antibodies. Suitable radiolabels include, but are not limited to, $I^{125}$. In one embodiment, a fixed concentration of $I^{125}$-labeled polypeptide is incubated with a series of dilution of an antibody specific to the polypeptide. When the unlabeled polypeptide is added to the system, the amount of the $I^{125}$-polypeptide that binds to the antibody is decreased. A standard curve can therefore be constructed to represent the amount of antibody-bound $I^{125}$-polypeptide as a function of the concentration of the unlabeled polypeptide. From this standard curve, the concentration of the polypeptide in unknown samples can be determined. Various protocols for conducting RIA to measure the levels of polypeptides in peripheral blood samples are well known in the art.

Suitable antibodies for this invention include, but are not limited to, polyclonal antibodies, monoclonal antibodies, chimeric antibodies, humanized antibodies, single chain antibodies, Fab fragments, and fragments produced by a Fab expression library. Neutralizing antibodies (i.e., those which inhibit dimer formation) can also be used.

Polyclonal antibodies can be prepared by immunizing a suitable subject with RCC disease gene products or fragments thereof. The antibody titer in the immunized subject can be monitored over the time using standard techniques, such as ELISA. The antibodies can be isolated from the immunized subject using techniques well known in the art.

In one embodiment, hybridomas capable of producing antibodies against RCC disease gene products are prepared. RCC disease gene products can be prepared using bacteria or other cells transformed or transfected with the polynucleotide sequences encoding the gene products. The purified gene products, or fragments thereof, are used to immunize a vertebrate, such as a mammal. Suitable mammals include mice, rabbits and sheep. Preferably, the fragment used for immunization comprises at least 8 amino acid residues, more preferably at least 12 amino acid residues, highly preferably at least 16 amino acid residues, and most preferably at least 20 amino acid residues.

Immunogenic fragments (epitopes) in the gene products can be identified using known techniques. Preferred epitopes are regions that are located on the surfaces of the gene products. These regions are usually hydrophilic.

Splenocytes are isolated from the immunized vertebrate and fused with an immortalized cell line (such as a myeloma) to form hybridomas. Preferably, the immortal cell line is derived from the same mammalian species as the lymphocytes. For example, murine hybridomas can be made by fusing an immortalized mouse cell line with lymphocytes isolated from a mouse that is immunized with an immunogenic preparation of the present invention. Preferred immortalized cell lines include mouse myeloma cell lines that are sensitive to culture medium containing hypoxanthine, aminopterin and thymidine ("HAT medium"). Suitable myeloma cell lines include, but are not limited to, the P3-NS1/l-Ag4-1, P3-x63-Ag8.653 or Sp210-Ag14 myeloma lines, all of which are available from ATCC. In one embodiment, HAT-sensitive mouse myeloma cells are fused to mouse splenocytes using polyethylene glycol ("PEG"). Hybridoma cells thus produced are selected against HAT medium, which kills unfused or unproductively fused myeloma cells. Hybridoma cells which produce monoclonal antibodies against the RCC disease gene products can be detected by screening the hybridoma culture supernatants.

Monoclonal antibodies can also be prepared by screening a recombinant combinatorial immunoglobulin library (e.g., an antibody phase display library). Kits for generating and screening phage display libraries are commercially available (e.g., the *Pharmacia Recombinant Phage Antibody System*, Catalog No. 27-9400-01; and the Stratagene *SurfZAP*™ *Phage Display Kit*, Catalog No. 240612).

The antibodies suitable for this invention also include "single-chain Fv" or "scFv." The scFv fragments comprise the $V_H$ and $V_L$ domains of an antibody. Generally, the scFv polypeptide further comprises a polypeptide linker between, the $V_H$ and $V_L$ domains. The polypeptide linker enables the scFv to form the desired structure for antigen binding. Additionally, recombinant antibodies, such as chimeric and humanized monoclonal antibodies, can be prepared, as appreciated by one of ordinary skill in the art.

Humanized antibodies can also be used. Humanized forms of non-human (e.g., murine) antibodies are chimeric immunoglobulins, immunoglobulin chains, or fragments thereof (such as Fv, Fab, Fab', F(ab')$_2$ or other antigen-binding subsequences of antibodies) which contain minimal sequence derived from non-human immunoglobulin. Humanized antibodies are derived from human immunoglobulins in which the residues forming the complementary determining regions (CDRs) are replaced by the residues from CDRs of a non-human antibody, such as a mouse, rat or rabbit antibody having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. The humanized antibody can comprise at least one or two variable domains, in which all or substantially all of the CDR regions correspond to those of a non-human immunoglobulin and all or substantially all of the constant regions are those of a human immunoglobulin consensus sequence. The humanized antibody preferably comprises at least a portion of an immunoglobulin constant region (Fc) of a human immunoglobulin.

Humanized antibodies can be produced using transgenic mice which are incapable of expressing endogenous immunoglobulin heavy and light chains but can express human heavy and light chains. The transgenic mice are immunized in the normal fashion with a selected antigen. Monoclonal antibodies directed against the antigen can be obtained using conventional hybridoma technology. The human immunoglobulin transgenes harbored in the transgenic mice rearrange during B cell differentiation, and subsequently undergo class switching and somatic mutation. Using this technique, therapeutically useful IgG, IgA and IgE antibodies can be prepared.

In addition, humanized antibodies which recognize a selected epitope can be generated using a technique referred to as "guided selection." In this approach a selected non-human monoclonal antibody, e.g., a murine antibody, is used to guide the selection of a humanized antibody recognizing the same epitope.

In one embodiment, the antibodies of the present invention can bind to the corresponding RCC disease gene products or the desired antigens with a binding affinity constant $K_d$ of at least $10^4$ $M^{-1}$, such as at least $10^5$ $M^{-1}$, $10^6$ $M^{-1}$, $10^7$ $M^{-1}$ or more.

The antibodies of this invention can be labeled with one or more detectable moieties to allow for detection of antibody-antigen complexes. The detectable moieties can include compositions detectable by spectroscopic, enzymatic, photochemical, biochemical, bioelectronic, immunochemical, electrical, optical or chemical means. The detectable moieties include, but are not limited to, radioisotopes, chemiluminescent compounds, labeled binding proteins, heavy metal atoms, spectroscopic markers such as fluorescent markers and dyes, magnetic labels, linked enzymes, mass spectrometry tags, spin labels, electron transfer donors and acceptors, and the like.

In accordance with yet another aspect of the present invention, the levels of polypeptides in peripheral blood samples can be determined by detecting the biological activities associated with the polypeptides. If a biological function/activity of a polypeptide is known, suitable in vitro bioassays can be designed to evaluate the biological function/activity, thereby determining the amount of the polypeptide in the sample.

The expression levels of RCC disease genes or the respective CPSs can be compared to the reference expression levels using various methods. These reference levels can be determined using peripheral blood samples isolated from disease-free humans, RCC or other solid tumor patients. The comparison can be performed using the fold change or the absolute difference between the expression levels to be compared. One or more RCC disease genes or CPSs can be used in the comparison. For instance, at least 2, 3, 4, 6, 8, 10, 12, 14, 16, 18, 20, 30, 40, 50, 60, 70, 80, 90, 100, 150, 200 or more RCC disease genes or CPSs can be used.

The expression patterns can also be compared by using one or more ratios between the expression levels of different disease genes. Other suitable measures or indicators can also be employed for assessing the relationship or difference between different expression patterns.

The use of multiple CPSs or RCC disease genes can reduce the risk of false prediction. In one embodiment, if more than 50% (such as 60%, 70%, 80% or 90%) of the selected CPSs or RCC disease genes suggest that the test human has RCC or is RCC-free, then a prediction for RCC or RCC-free will be made respectively. In another embodiment, the gene expression-based comparison is combined with other clinical evidence in predicting RCC and/or other solid tumors.

In a preferred embodiment, the RCC disease genes used for predicting RCC versus RCC-free include or consist of one or more genes selected from the group consisting of EEF1A2, TLR2, BRF2, LGALS3, SNRPG, DKFZP586E1621, NUMA1, SOD2, AKR1B1, DUSP6, SMARCE1, KIAA0669, MSF, IL1RN, PTMA, KIAA0410, PSMD3, T54, C1QBP, and OSR1. For instance, the RCC disease genes used for RCC prediction can include or consist of at least 2, 4, 6, 8, 10, 12, 14, 16, 18 or 20 genes selected from the group. For another instance, the RCC disease genes used for diagnosis can comprise (1) at least 1, 2, 3, 4, 5, 6, 7, 8, 9, or 10 genes selected from the group consisting of TLR2, LGALS3, DKFZP586E1621, SOD2, DUSP6, KIAA0669, IL1RN, KIAA0410, T54 and OSR1, and/or (2) at least 1, 2, 3, 4, 5, 6, 7, 8, 9, or 10 genes selected from the group consisting of EEF1A2, BRF2, SNRPG, NUMA1, AKR1B1, SMARCE1, MSF, PTMA, PSMD3 and C1QBP.

In another preferred embodiment, the CPSs used for predicting RCC versus RCC-free include or consist of one or more CPSs selected from the group consisting of CPS 1, CPS 3, CPS 4, CPS 6, CPS 18, CPS 38, CPS 53, CPS 255, CPS 256, CPS 257, CPS 258, CPS 259, CPS 260, CPS 261, CPS 262, CPS 263, CPS 264, CPS 265, CPS 266, and CPS 267. For instance, the CPSs used for RCC prediction can include or consist of at least 2, 4, 6, 8, 10, 12, 14, 16, 18 or 20 CPSs selected from the group. For another instance, the CPSs used for diagnosis can comprise (1) at least 1, 2, 3, 4, 5, 6, 7, 8, 9 or 10 CPSs selected from the group consisting of CPS 1, CPS 3, CPS 4, CPS 6, CPS 18, CPS 38, CPS 53, CPS 261, CPS 264 and CPS 267, and/or (2) at least 1, 2, 3, 4, 5, 6, 7, 8, 9 or 10 CPSs selected from the group consisting of CPS 255, CPS 256, CPS 257, CPS 258, CPS 259, CPS 260, CPS 262, CPS 263, CPS 265, and CPS 266.

In yet another preferred embodiment, the RCC disease genes used for predicting RCC versus RCC-free include or consist of one or more genes selected from the group consisting of CD44, KIAA0410, MARCO, MAP3K8, NSP-CL, PIP5K1C, NRG1, RAB31, LGALS3, MEF2D, ITGA7, LHFPL2, ETS2, KHSRP, ENIGMA, UNK_AF038187, RAB13, TLR2, T54 and DUSP6. For instance, the RCC disease genes used for prediction can include or consist of at least 2, 4, 6, 8, 10, 12, 14, 16, 18 or 20 genes selected from the group.

In still another preferred embodiment, the CPSs used for predicting RCC versus RCC-free include or consist of one or more CPSs selected from the group consisting of CPSs 1, 3, 4, 5, 6, 7, 9, 10, 11, 16, 28, 31, 268, 264, 279, 280, 281, 282, 283 and 284. For instance, the CPSs used for prediction can include or consist of at least 4, 6, 8, 10, 12, 14, 16, 18 or 20 CPSs selected from the group.

In another preferred embodiment, the RCC disease genes used for predicting RCC and/or other solid tumors, such as prostate cancer and head/neck cancer, include or consist of one or more genes selected from the group consisting of CD44, CRADD, CCRL2, KIAA0837, KIAA0707, KIAA1113, EREG, UNK_AL050119, PPARD, CTSL, ATP2B1, UNK_AF052115, MITF, STAT3, KIAA0410, TPD52L2, UNK_AI732885, MARCO, LOC64116, and PDNP2. For instance, the RCC disease genes used for prediction can include or consist of at least 2, 4, 6, 8, 10, 12, 14, 16, 18 or 20 genes selected from the group.

In yet another preferred embodiment, the CPSs used for predicting RCC and/or other solid tumors, such as prostate cancer and head/neck cancer, include or consist of one or more CPSs selected from the group consisting of CPSs 17, 31, 37, 50, 59, 64, 69, 71, 264, 268, 269, 270, 271, 272, 273, 274, 275, 276, 277 and 278. For instance, the CPSs used for prediction can include or consist of at least 2, 4, 6, 8, 10, 12, 14, 16, 18 or 20 CPSs selected from the group.

In one embodiment, the RCC disease genes used for predicting solid tumor versus solid tumor-free include or consist of one or more genes selected from the group consisting of NUMA1, CXCR4, IL10RA, M9, FAU, BRF2, RPS6, EEF1A2, BAG5, AKR1B1, UNK_AL022721, C1QBP, DKZP586E0820, NONO, PSMD3, UNK_N74607, UNK_AI743507, MAPKAPK5, and UNK_U79297. For instance, the RCC disease genes used for prediction can include or consist of at least 2, 4, 6, 8, 10, 12, 14, 16, 18 or 20 genes selected from the group.

In another embodiment, the CPSs used for predicting solid tumor versus solid tumor-free include or consist of one or more CPSs selected from the group consisting of CPSs 258, 285, 107, 286, 287, 256, 288, 255, 289, 259, 290, 266, 291, 292, 265, 131, 293, 294 and 295. For instance, the CPSs used for prediction can include or consist of at least 2, 4, 6, 8, 10, 12, 14, 16, 18 or 20 CPSs selected from the group.

Comparison of the expression profiles can also be performed based on a quantitative hybridization of arrayed DNA clones, the serial analysis of gene expression (SAGE) technology, or electronic analysis, such as the Transcript Imaging tool or the GEMTOOLS gene expression analysis program (Incyte Pharmaceuticals) or the GeneCalling and Quantitative Expression Analysis technology (Curagen). Algorithms, such as pattern recognition programs, can be used to compare the expression profiles of RCC disease genes with reference expression profiles.

E. RCC and Other Solid Tumor Prediction Based On Weighted Voting Algorithm

In accordance with one aspect of this invention, a weighted voting algorithm is used for comparing the expression profiles of a set of RCC disease genes in the human under diagnosis, to the expression profiles of the same set of RCC disease genes in disease-free humans and known RCC or solid tumor patients. The weighted voting algorithm is described in T. R. Golub, et al., Science, 286: 531-537 (1999), and D. K. Slonim et al., Procs. of the Fourth Annual International Conference on Computational Molecular Biology, Tokyo, Japan, April 8-11, p263-272 (2000). The algorithm can involve two-class or multi-class analysis. Multi-class analysis software, such as GeneCluster 2 software, is available from MIT Center for Genome Research at Whitehead Institute. The algorithm is capable of assigning the human under diagnosis to one of at least two classes.

Under one form of the algorithm, the human to be diagnosed is assigned to one of two classes (referred to as class 0 and class 1). For instance, class 0 may represent and consist of disease-free humans, and class 1 may represent and consist of RCC patients. A set of RCC disease genes are selected to create a class predictor (classifier). Each gene in the class predictor casts a weighted vote for one of the two classes (class 0 and class 1). The vote of gene "g" can be defined as $v_g=a_g(x_g-b_g)$, wherein $a_g=P(g,c)$ reflects the correlation between the expression level of gene "g" and the class distinction, $b_g=[x0(g)+x1(g)]/2$ is the average of the mean logs of the expression levels of gene "g" in class 0 and class 1, and $x_g$ represents the normalized log of the expression level of gene "g" in the test sample. A positive $v_g$ indicates a vote for class 0, and a negative $v_g$ indicates a vote for class 1. V0 denotes the sum of all positive votes, and V1 denotes the absolute value of the sum of all negative votes. A prediction strength PS is defined as $PS=(V0-V1)/(V0+V1)$.

Cross-validation can be used to evaluate the accuracy of the class predictor created under the weighted voting algorithm. Briefly, one sample which has been used to identify the RCC disease genes under the neighborhood analysis is withheld. A class predictor is created based on the rest samples, and then used to predict the class of the sample withheld. This process can be repeated for each sample that has been used in the neighborhood analysis. Class predictors comprising different RCC disease genes can be evaluated using the cross-validation process, and the best class predictor with the most accurate predication can be identified. In addition, a suitable prediction strength (PS) threshold can be assessed by plotting the cumulative cross-validation error rate against the prediction strength.

In one embodiment, a positive predication that a test sample belongs to class 0 or class 1 can be made if the absolute value of PS for the test sample is no less than 0.3. Other PS threshold, such as no less than 0.1 or 0.2, can also be used.

In another embodiment, the class predictor or classifier consists of n RCC disease genes identified under the neighborhood analysis. A half of these RCC disease genes has the largest P(g,c) scores, and the other half has the largest −P(g,c) scores. The number n is the only free parameter in defining the class predictor.

Subsection G of this specification depicts detailed examples of building and training the RCC disease classifiers.

In a preferred embodiment, the class predictor comprises or consists of at least 2, 4, 6, 8, 10, 12, 14, 16, 18 or 20 genes selected from EEF1A2, TLP2, BRF2, LGALS3, SNRPG, DKFZP586E1621, NUMA1, SOD2, AKR1B1, DUSP6, SMARCE1, KIAA0669, MSF, IL1RN, PTMA, KIAA0410, PSMD3, T54, C1QBP, and OSR1. For instance, a 2-gene class predictor can consist of TLR2 and EEF1A2. A 4-gene class predictor can consist of TLR2, LGALS3, EEF1A2, and BRF2. A 6-gene class predictor can consist of TLR2, LGALS3, DKFZP586E1621, EEF1A2, BRF2, and SNRPG. An 8-gene class predictor can consist of TLR2, LGALS3, DKFZP586E1621, SOD2, EEF1A2, BRF2, SNRPG, and NUMA1. A 10-gene class predictor can consist of TLR2, LGALS3, DKFZP586E1621, SOD2, DUSP6, EEF1A2, BRF2, SNRPG, NUMA1, and AKR1B1. A 12-gene class predictor can consist of TLR2, LGALS3, DKFZP586E1621, SOD2, DUSP6, KIAA0669, EEF1A2, BRF2, SNRPG, NUMA1, AKR1B1, and SMARCE1. A 14-gene class predictor can consist of TLR2, LGALS3, DKFZP586E1621, SOD2, DUSP6, KIAA0669, IL1RN, EEF1A2, BRF2, SNRPG, NUMA1, AKR1B1, SMARCE1, and MSF. A 16-gene class predictor can consist of TLR2, LGALS3, DKFZP586E1621, SOD2, DUSP6, KIAA0669, IL1RN, KIAA0410, EEF1A2, BRF2, SNRPG, NUMA1, AKR1B1, SMARCE1, MSF, and PTMA. An 18-gene class predictor can consist of TLR2, LGALS3, DKFZP586E1621, SOD2, DUSP6, KIAA0669, IL1RN, KIAA0410, T54, EEF1A2, BRF2, SNRPG, NUMA1, AKR1B1, SMARCE1, MSF, PTMA, and PSMD3. Finally, a 20-gene class predictor consists of EEF1A2, TLR2, BRF2, LGALS3, SNRPG, DKFZP586E1621, NUMA1, SOD2, AKR1B1, DUSP6, SMARCE1, KIAA0669, MSF, IL1RN, PTMA, KIAA0410, PSMD3, T54, C1QBP, and OSR1.

In another preferred embodiment, the class predictor comprises (1) at least 1, 2, 3, 4, 5, 6, 7, 8, 9, or 10 genes selected from the group consisting of TLR2, LGALS3, DKFZP586E1621, SOD2, DUSP6, KIAA0669, IL1RN, KIAA0410, T54 and OSR1, and (2) at least 1, 2, 3, 4, 5, 6, 7, 8, 9, or 10 genes selected from the group consisting of EEF1A2, BRF2, SNRPG, NUMA1, AKR1B1, SMARCE1, MSF, PTMA, PSMD3 and C1QBP.

In yet another preferred embodiment, the class predictor comprises or consists of 2, 4, 6, 8, 10, 12, 14, 16, 18 or 20 genes selected from the group consisting of CD44, KIAA0410, MARCO, MAP3K8, NSP-CL, PIP5K1C, NRG1, RAB31, LGALS3, MEF2D, ITGA7, LHFPL2, ETS2, KHSRP, ENIGMA, UNK_AF038187, RAB13, TLR2, T54 and DUSP6.

In still another preferred embodiment, the class predictor comprises or consists of 2, 4, 6, 8, 10, 12, 14, 16, 18 or 20 genes selected from the group consisting of CD44, CRADD, CCRL2, KIAA0837, KIAA0707, KIAA1113, EREG, UNK_AL050119, PPARD, CTSL, ATP2B1, UNK_AF052115, MITF, STAT3, KIAA0410, TPD52L2, UNK_AI732885, MARCO, LOC64116, and PDNP2. The class predictors of this embodiment can be used to predict RCC, prostate cancer, head/neck cancer, and disease-free.

In still yet another preferred embodiment, the class predictor comprises or consists of 2, 4, 6, 8, 10, 12, 14, 16, 18 or 20 genes selected from the group consisting of NUMA1, CXCR4, IL10RA, M9, FAU, BRF2, RPS6, EEF1A2, BAG5, AKR1B1, UNK_AL022721, C1QBP, DKZP586E0820, NONO, PSMD3, UNK_N74607, UNK_AI743507, MAP-KAPK5, and UNK_U79297. The class predictors of this embodiment can be used to predict solid tumor versus solid tumor-free, regardless of the particular type of the solid tumor. The solid tumor predictable in this embodiment includes RCC, prostate cancer, and head/neck cancer.

In one embodiment, the reference expression levels of RCC disease genes, such as the expression levels derived from disease-free humans or known RCC or solid tumor patients, are stored in a database and are readily retrievable. In another embodiment, the comparison between expression profiles of various genes is performed electronically, such as using a computer system. The computer system comprises a processor coupled to a memory which stores data representing the expression profiles being compared. Preferably, the memory is readable as well as rewritable. The expression data stored in the memory can be changed, retrieved or otherwise manipulated. The memory also stores one or more programs capable of causing the processor to compare the stored expression profiles. For instance, the program may be able to execute a weighted voting algorithm. The processor can also be coupled to a polynucleotide array scanner and is capable of receiving signals from the scanner.

In another embodiment, a confidence threshold is established to optimize the accuracy of prediction and minimize the incidence of both false positive and false negative results. Average confidence scores collected for the accumulating pool of correctly diagnosed patients and correctly non-diagnosed disease-free individuals can be calculated and a reference range of values, for the particular predictive gene set diagnostic in question, can be reported.

F. Other Applications

The systematic gene expression analysis of this invention can be used to identify genes that are differentially expressed in peripheral blood samples isolated at different stages of the progression, development or treatment of RCC and/or other solid tumors. Genes thus-identified are molecular markers for monitoring the progression, development or treatment of RCC and/or other solid tumors. Genes thus-identified can also be used as surrogate markers for evaluating the efficacy of a treatment for RCC or other solid tumors.

A clinical challenge concerning RCC and other solid tumors is the highly variable response of patients to therapy. The basic concept of pharmacogenomics is to understand a patient's genotype in relation to available treatment options and then individualize the most appropriate option for the patient. Different classes of RCC and/or other solid tumor patients can be created based on their different responses to a given therapy. Differentially expressed genes in these classes can be identified using the global gene expression analysis. Genes thus-identified can serve as predictive markers for forecasting whether a particular patient will be more or less responsive to the given therapy. For patients predicted to have a favorable outcome for the therapy, efforts to minimized toxicity of the therapy may be considered, whereas for those predicted not to respond to the therapy, treatment with other therapies or experimental regimes can be used.

The present invention also contemplates expression vectors encoding the RCC disease genes. The RCC disease genes may be under-expressed in RCC tumor cells. By introducing of the expression vectors into the patients, abnormal expression of the target genes may be corrected.

Suitable expression or gene delivery vectors are well known in the art. Preferably, these vectors are viral vectors, such as retroviral, lentiviral, adenoviral, adeno-associated viral (AAV), herpes viral, or alphavirus vectors. The viral vectors can also be astrovirus, coronavirus, orthomyxovirus, papovavirus, paramyxovirus, parvovirus, picornavirus, poxvirus, or togavirus viral vectors.

Delivery of the expression constructs is not limited to the above mentioned viral vectors. Other delivery methods can also be employed. These methods include nucleic acid expression vectors, polycationic condensed DNA linked or unlinked to killed adenovirus, ligand linked, gene guns, ionizing radiation, nucleic charge neutralization, or fusion with cell membranes. Naked DNA can also be employed. Exemplary methods to use naked DNA are known in the art. Uptake efficiency may be improved using biodegradable latex beads. This method can be further improved by treating the beads to increase their hydrophobicity. Liposome-based methods can also be used.

In addition, this invention contemplates expression vectors capable of expressing sequences that are anti-sense to a RCC disease gene of interest. The RCC disease gene of interest may be over-expressed in RCC or other solid tumor patients. By introducing the antisense expression vector into these patients, the abnormal expression of the gene can be corrected.

An "antisense" polynucleotide comprises a nucleotide sequence which is complementary to a "sense" polynucleotide which encodes a protein. An antisense polynucleotide can bind via hydrogen bonds to the sense polynucleotide. The antisense polynucleotide can be complementary to an entire coding strand of the target gene, or a portion thereof. In one embodiment, the antisense polynucleotide molecule is antisense to a "noncoding region" in the coding strand of the target gene.

Antisense polynucleotides can be designed according to the rules of Watson and Crick base pairing. They may be oligonucleotides which are antisense to only a portion of the target gene. An antisense polynucleotide can be, for example, about 5, 10, 15, 20, 25, 30, 35, 40, 45 or 50 nucleotides in length. An antisense polynucleotide can be constructed using chemical synthesis and enzymatic ligation reactions as appreciated by one of skill in the art. For example, an antisense polynucleotide (e.g., an antisense oligonucleotide) can be chemically synthesized using naturally occurring nucleotides or variously modified nucleotides designed to increase the biological stability of the molecules or to increase the physical stability of the duplex formed between the antisense and sense polynucleotides. Alternatively, the antisense polynucleotide can be produced biologically using an expression vector into which a polynucleotide has been subcloned in an antisense orientation (i.e., RNA transcribed from the inserted polynucleotide will be of an antisense orientation to the target polynucleotide of interest).

The antisense polynucleotides can be administered to a subject or applied in situ such that they hybridize or bind to cellular mRNAs and/or genomic DNAs of the target gene, thereby inhibiting the expression of the target gene. The hybridization can result in a stable duplex via conventional nucleotide complementarity. An example route for administering antisense polynucleotides includes direct injection at a tissue site. Antisense polynucleotides can also be modified first, and then administered systemically. For example, for systemic administration, antisense molecules can be modified such that they specifically bind to receptors or antigens expressed on a selected cell surface. Suitable modifications include linking the antisense polynucleotides to peptides or antibodies which bind to the cell surface receptors or antigens. In addition, the antisense polynucleotides can be delivered to cells using vectors. To achieve sufficient intracellular concentrations of the antisense molecules, strong pol II or pol III promoters may be used in the vectors.

In one embodiment, the antisense polynucleotides are α-anomeric polynucleotides. An α-anomeric polynucleotide molecule forms specific a double-stranded hybrid with a complementary RNA in which, contrary to the usual β-units, the strands run parallel to each other. The antisense polynucleotide molecule can also comprise a 2'-o-methylribonucleotide or a chimeric RNA-DNA analogue.

In another embodiment, the antisense polynucleotide is a ribozyme. Ribozymes are catalytic RNA molecules with ribonuclease activity which are capable of cleaving a single-stranded polynucleotide, such as an mRNA, to which they have a complementary region. Thus, ribozymes can be used to catalytically cleave mRNA transcripts of the target gene in order to inhibit its expression. mRNAs transcribed from the target gene can be used to select from a pool of RNA molecules a catalytic RNA having a specific ribonuclease activity. Alternatively, the expression of the target gene can be inhibited by using nucleotide sequences complementary to the regulatory region (e.g., the promoter and/or enhancers). These nucleotide sequences can form triple helical structures that prevent transcription of the gene in target cells.

Expression of the target gene can also be inhibited using RNA interference ("RNA$_i$"). This is a technique used in post transcriptional gene silencing ("PTGS"), in which the targeted gene activity is specifically abolished. RNA$_i$ resembles in many aspects PTGS in plants and has been detected in many invertebrates including trypanosome, hydra, planaria, nematode and fruit fly (*Drosophila melanogaster*). It may be involved in the modulation of transposable element mobilization and antiviral state formation. RNA in mammalian systems is disclosed in PCT application WO00/63364. In one embodiment, dsRNA of at least about 21 nucleotides, homologous to the target gene, is introduced into cells.

Antibodies against the polypeptides encoded by the RCC disease genes can be also prepared and administered to patients in order to affect the function of the RCC disease genes. In one embodiment, the antibodies can reduce at least 25% of the activity of the target gene. Preferably, the antibodies reduce at least about 50% of the activity of the corresponding gene. Highly preferably, the antibodies reduce about 95-100% of the activity of the target gene.

A pharmaceutical composition comprising the antibody or expression vector of this invention can be made. The pharmaceutical composition also includes a pharmaceutically acceptable carrier. As used herein, a "pharmaceutically acceptable carrier" is intended to include any and all solvents, solubilizers, fillers, stabilizers, binders, absorbents, bases, buffering agents, lubricants, controlled release vehicles, diluents, emulsifying agents, humectants, lubricants, dispersion media, coatings, antibacterial or antifungal agents, isotonic and absorption delaying agents, and the like, compatible with pharmaceutical administration. The use of such media and agents for pharmaceutically active substances is well-known in the art. Except insofar as any conventional media or agent is incompatible with the active compound, use thereof in the compositions is contemplated. Supplementary agents can also be incorporated into the compositions.

A pharmaceutical composition can be formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine; propylene glycol or other synthetic solvents; antibacterial agents such as benzyl alcohol or methyl parabens; antioxidants such as ascorbic acid or sodium bisulfate; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Examples of suitable RCC disease genes that can be used as the targets of gene therapy or drug treatment include, but are not limited to, DUSP6, DRD2, ABL1, GUK1, MAP2K3, BSG, PPARG, TNNT1, ERN1, C4A, CCR1, PPARD, PDXK, MMP9, PPP3CB, CHRNA4, C8FW, PDNP2, ALDH5A1, and GPR12. Other examples include the RCC disease genes that are over- or under-expressed in both PBMCs and RCC tumor tissues.

In one embodiment, the present invention provides a kit comprising one or more polynucleotides, each of said one or more polynucleotides capable of hybridizing under stringent conditions to a gene selected from Gene-Table-4. Any primer/probe of this invention, or the complement thereof, can be included in the kit. The polynucleotide(s) can be labeled with fluorescent, radioactive, or other detectable moieties. In one instance, the one or more polynucleotides are contained in vials, tubes, bottles or other containing means. In another instance, the one or more polynucleotides are stably attached to a solid support. Nucleic acid hybridization can be directly carried out on the solid support. In yet another instance, the kit contains at least 2, 3, 4, 5, 10, 15, 20, or more polynucleotides, each different polynucleotide capable of hybridizing under stringent conditions to a different respective gene selected from Gene-Table-4

In another embodiment, the kit of the present invention contains one or more antibodies capable of binding to the polypeptides encoded by the genes selected from Gene-Table-4. The antibodies can be labeled or unlabeled. Any antibody of this invention can be included in the kit. In one example, the kit also includes other immunodetection reagents, such as secondary antibodies, controls or enzyme substrates. In another example, the antibodies are included in one or more containers. In yet another example, the antibodies are stably bound to a solid support, such as a film, membrane, column matrix, or microtiter plate wells. Immunoassays can be performed directly on the solid support. In still yet another example, the kit contains at least 2, 3, 4, 5, 10, 15, 20, or more different antibodies, each different antibody capable of binding to a polypeptide encoded by a different respective genes selected from Gene-Table-4.

It should be understood that the above-described embodiments and the following examples are given by way of illustration, not limitation. Various changes and modifications within the scope of the present invention will become apparent to those skilled in the art from the present description.

EXAMPLES

Example 1

Isolation of RNA and Preparation of Labeled Microarray Targets

PBMCs from the clinical trials were isolated from whole blood samples (8mL) collected into CPT tubes according to the standard procedure. All disease-free and RCC blood samples were shipped or stored overnight prior to processing. PBMCs were purified over Ficoll gradients, washed two times with PBS and counted. Total RNA was isolated from PBMC pellets using the RNeasy mini kit (Qiagen, Valencia, Calif.). Labeled target for oligonucleotide arrays was prepared using a modification of the procedure described in Lockhart, et al., Nature Biotechnology, 14: 1675-80 (1996). 2 µg total RNA was converted to cDNA by priming with an oligo-dT primer containing a T7 DNA polymerase promoter at the 5' end. The cDNA was used as the template for in vitro transcription using a T7 DNA polymerase kit (Ambion, Woodlands, Tex.) and biotinylated CTP and UTP (Enzo). Labeled cRNA was fragmented in 40 mM Tris-acetate pH 8.0, 100 mM KOAc, 30 mM MgOAc for 35 minutes at 94° C. in a final volume of 40 µl.

Example 2

Hybridization to Affymetrix Microarrays and Detection of Fluorescence

Individual RCC and disease-free samples were hybridized to HgU95A genechip (Affymetrix). No samples were pooled. 45 RCC patients and 20 disease-free volunteers were involved in the study. Tumors of the RCC patients were histopathologically classified as specific renal cell carcinoma subtypes using the Heidelberg classification of renal cell tumors described in Kovacs, et al., J. Pathol., 183:131-133 (1997). Among the 45 RCC tumor samples, twenty-four samples were classified as conventional (clear cell) carcinomas, one sample was classified as granular, three samples were classified as papillary, seven samples were classified as mixed subtypes, and ten tumor samples were classified as unknown.

10 µg of labeled target was diluted in 1×MES buffer with 100 µg/ml herring sperm DNA and 50 µg/ml acetylated BSA. To normalize arrays to each other and to estimate the sensitivity of the oligonucleotide arrays, in vitro synthesized transcripts of 11 bacterial genes were included in each hybridization reaction as described in Hill et al., Science, 290: 809-812 (2000). The abundance of these transcripts ranged from 1:300,000 (3 ppm) to. 1:1000 (1000 ppm) stated in terms of the number of control transcripts per total transcripts. As determined by the signal response from these control transcripts, the sensitivity of detection of the arrays ranged between about 1:300,000 and 1:100,000 copies/million. Labeled probes were denatured at 99° C. for 5 minutes and then 45° C. for 5 minutes and hybridized to oligonucleotide arrays comprised of over 12,500 human genes (HgU95A, Affymetrix). Arrays were hybridized for 16 hours at 45° C. The hybridization buffer was comprised of 100 mM MES, 1 M [Na$^+$], 20 mM EDTA, and 0.01% Tween 20. After hybridization, the cartridges were washed extensively with wash buffer (6×SSPET), for instance, three 10-minute washes at room temperature. These hybridization and washing conditions are collectively referred to as "nucleic acid array hybridization conditions." The washed cartridges were then stained with phycoerythrin coupled to streptavidin.

12×MES stock contains 1.22 M MES and 0.89 M [Na$^+$]. For 1000 ml, the stock can be prepared by mixing 70.4 g MES free acid monohydrate, 193.3 g MES sodium salt and 800 ml of molecular biology grade water, and adjusting volume to 1000 ml. The pH should be between 6.5 and 6.7. 2× hybridization buffer can be prepared by mixing 8.3 mL of 12×MES stock, 17.7 mL of 5 M NaCl, 4.0 mL of 0.5 M EDTA, 0.1 mL of 10% Tween 20 and 19.9 mL of water. 6×SSPET contains 0.9 M NaCl, 60 mM NaH$_2$PO$_4$, 6 mM EDTA, pH 7.4, and 0.005% Triton X-100. In some cases, the wash buffer can be replaced with a more stringent wash buffer. 1000 ml stringent wash buffer can be prepared by mixing 83.3 mL of 12×MES stock, 5.2 mL of 5 M NaCl, 1.0 mL of 10% Tween 20 and 910.5 mL of water.

Example 3

Gene Expression Data Analysis

Data analysis was performed on raw fluorescent intensity values using GENECHIP 3.2 software (Affymetrix). GENECHIP 3.2 software uses an algorithm to calculate the likelihood as to whether a gene is "absent" or "present" as well as a specific hybridization intensity value or "average difference" for each transcript represented on the array. The algorithms used in these calculations are described in the Affymetrix GeneChip Analysis Suite User Guide (Affymetrix). The "average difference" for each transcript was normalized to "frequency" values according to the procedures of Hill et al., Science, 290: 809-812 (2000). This was accomplished by referring the average difference values on each chip to a calibration curve constructed from the average difference values for the 11 control transcripts with known abundance that were spiked into each hybridization solution. This process also served to normalize between arrays.

Specific transcripts were evaluated further if they met the following criteria. First, genes that were designated "absent" by the GENECHIP 3.2 software in all samples were excluded from the analysis. Second, in comparisons of transcript levels between arrays, a gene was required to be present in at least one of the arrays. Third, for comparisons of transcript levels between groups, a Student's t-test was applied to identify a subset of transcripts that had a significant ($p<0.05$) differences in frequency values. In certain cases, a fourth criterion, which requires that average fold changes in frequency values across the statistically significant subset of genes be 2-fold or greater, was also used.

Unsupervised hierarchical clustering of genes and/or arrays on the basis of similarity of their expression profiles was performed using the procedure described in Eisen, et al., Proc. Nat. Acad. Sci., U.S.A., 95: 14863-14868 (1998). Nearest neighbor prediction analysis and supervised cluster analysis was performed using metrics illustrated in Golub et al., Science, 286: 531-537 (1999). For hierarchical clustering and nearest neighbor prediction analysis, data were log transformed and normalized to have a mean value of zero and a variance of one. A Student's t-test was used to compare disease-free PBMC expression profiles to renal carcinoma PBMC profiles. In the comparisons, a p value<0.05 was used to indicate statistical significance.

Expression profiles in various tissues can also be accessed and downloaded from the BioExpress database (GeneLogic, Gaithersburg Md.). GeneLogic GX2000 software based analysis tools including fold change analysis and electronic northerns can be utilized to calculate fold changes and distribution of expression values, and expression profiles for different samples can be exported using the expression analysis tool for further analysis in the hierarchical clustering package (Eisen, et al., Proc. Nat. Acad. Sci., U.S.A., 95: 14863-14868 (1998)).

A k-nearest neighbor's approach was used to perform a neighborhood analysis of real and randomly permuted data using a correlation metric ($P(g,c) = \mu_1 - \mu_2/\sigma_1 + \sigma_2$) where g is the expression vector of a gene, c is the class vector, $\mu_1$ and $\sigma_1$ define the mean expression level and standard deviation of the gene in class 1 and $\mu_2$ and $\sigma_2$ define the mean expression level and standard deviation of the gene in class 2. The measures of correlation for the 246 most statistically significant upregulated genes of the true defined classes (RCC versus disease-free) were compared to the most statistically significant measures of correlation observed in randomly permuted class distinctions. The top 1%, 5% and median distance measurements of 100 randomly permuted classes compared to the observed distance measurements for RCC and disease-free classes are plotted. FIG. 1 depicts the statistical verification of the RCC disease genes identified in this invention.

Example 4

Identification of RCC Disease Genes in Peripheral Blood

Tables 6 and 7 list 184 RCC disease genes which are ranked by the number of samples in which the gene was called present (# Present). The p-value of the Student's t-test ("T-test (p-value)") for each of the 184 RCC disease genes is also listed in Table 6. "Present" calls were calculated using GENECHIP 3.2 software by estimating whether a transcript was detected in a sample based on the strength of the gene's signal compared to background. See GeneChip® Expression Analysis Technical Manual, 701021 Rev.3 (1999-2002 Affymetrix, Inc.).

The "average difference" values for each transcript were normalized to "frequency" values using the scaled frequency normalization method in which the average differences for 11 control cRNAs with known abundance spiked into each hybridization solution were used to generate a global calibration curve. See Hill et al., Genome Biol., 2(12):research0055.1-0055.13 (2001), which is incorporated herein in its entirety by reference. This calibration was then used to convert average difference values for all transcripts to frequency estimates, stated in units of parts per million (ppm) which can range, but are not limited to, from 1:300,000 (i.e., 3 ppm) to 1:1000 (1000 ppm).

Expression profiling analysis of the 20 disease-free PBMC RNA samples and 45 RCC PBMC RNA samples revealed that of the 12,626 transcripts on the HgU95A chip, 5,249 transcripts met the initial criteria for further analysis. The initial criteria were (1) there was at least one present call, and (2) at least one frequency was over 10 ppm. On average, 4023 transcripts were detected as "present" in the 45 RCC PBMCs, while 4254 expressed transcripts were detected as "present" in the 20 disease-free PBMCs.

The percent coefficients of variation (i.e., mean frequency/S.D.×100) of each of the 5,249 original transcript levels across both groups of samples (45 RCC, 20 disease-free or normal PBMCs) were calculated (% COV). Transcripts were ranked where the least variable gene across the RCC samples received an RCC COV Rank=1 and the most variable gene across the RCC samples received an RCC COV Rank=5249. This process was repeated for the 20 disease-free (normal) PBMC samples and the Normal COV Rank was calculated in similar fashion, i.e., the least variable gene across the disease-free RCC samples received an Norm COV Rank=1 and the most variable gene across the disease-free samples received an Norm COV Rank=5249. In addition, fold changes were calculated as RCC Average Frequency/Normal Average Frequency, where a number equal to or greater than 2.0 was considered to represent a transcript induced in RCC PBMCs. Fold changes for each of the 5249 transcripts are depicted in Table 6. The number of samples possessing levels greater than 10 ppm ("# Freq>10") is also presented in Table 6 for each transcript. Moreover, the number of samples where the transcript was called present across the 45 RCC ("# Present RCC"), called present across the 20 Normals "(# Present Normal"), present at levels greater than 10 ppm across the 45 RCC ("#Freq>10 RCC"), and present at levels greater than 10 ppm across the 20 normals ("# Freq>10 Norm") are reported in Tables 6 and 7.

A fold change analysis and Student's t test (two-tailed distribution; two-sample unequal variance) identified transcripts differentially expressed between RCC PBMCs and disease-free PBMCs. Transcript levels of the 184 RCC disease genes shown in Tables 6 and 7 differed on average by 2-fold or greater between disease-free and RCC PBMCs with an unadjusted p-value below 0.001 in a t test between the groups. Of these, 132 transcripts were expressed in at least 15% of the PBMC samples (present in 10 or more of the 65 profiles).

Furthermore, the possibility that the observed differences in expression profiles of CPT-purified RCC PBMC pellets and CPT-purified disease-free PBMC pellets were simply investigated. A correlation coefficient for each gene's expression level with the level of granulocytes, lymphocytes and monocytes measured in PBMC samples was calculated. The relative correlation of expression of each gene with the level of each cell type was ranked to determine whether the disease-associated transcripts detected in RCC PBMCs were over-represented in a given cell population. The relative rank (out of the 5,249 transcripts passing the initial data filter) correlations of each transcript with the absolute numbers of granulocytes, lymphocytes and monocytes measured in PBMC samples were obtained. These analyses indicate that the vast majority of disease-associated transcripts identified in PBMCs of RCC patients were not simply correlated with specific cell subpopulations in peripheral blood.

Figure 2:
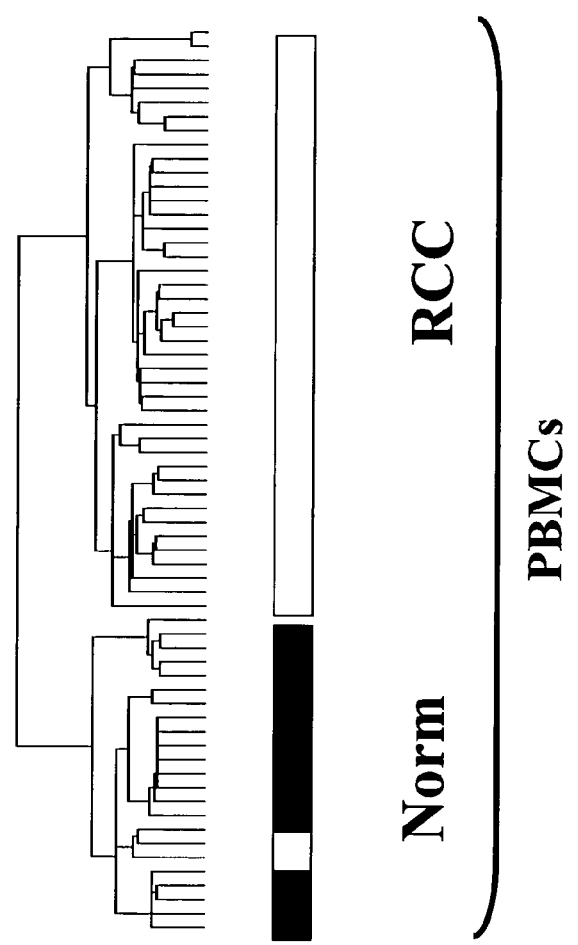
FIG. 2 shows a dendrogram of sample relatedness using expressed gene expression values.

An initial unsupervised cluster analysis approach which hierarchically groups samples and genes based on correlation coefficients (Eisen et al., supra) was performed using the 5,249 transcripts passing the initial filtering criteria. FIG. 2 depicts a dendrogram of sample relatedness using expressed gene expression values. RCC patient PBMC expression profiles were denoted by white bars and disease-free volunteer PBMC expression profiles were indicated by black bars. The dendrogram grouped the majority of RCC PBMCs (42/45) into a single RCC-specific cluster while expression patterns of disease-free PBMCs and a small subset of RCC PBMCs (3/45) formed a separate cluster.

Among the 184 RCC disease genes listed in Tables 6a and 7, there were several inflammatory-related genes, including Toll-like receptor 2, galectin-3, IL-1 receptor antagonist, and aquaporin-9, a water channel implicated in leukocyte migration. The unchanged levels of many other cytokines, chemokines and their respective receptors between normal and RCC PBMCs suggest that a specific, rather than global, activation of PBMCs constituted part of the disease signature in RCC peripheral blood.

A substantial number of the transcripts detected as significantly changed in PBMCs from RCC patients possess a significant degree of variability across the RCC PBMC profiles. This indicates that while the levels of these transcripts were significantly distinct from levels in normal PBMCs, there was relative heterogeneity of expression of these transcripts across RCC patients. It will be of great interest to determine whether any of these disease-associated yet significantly variable transcripts in RCC PBMCs will be correlated with any clinical categories of response, once clinical indices of outcome and follow-up are satisfactorily measured in these patients.

TABLE 6

184 DISEASE-ASSOCIATED TRANSCRIPTS IN RCC PATIENTS

| GenBank Accession Number | Gene Annotation | Unigene ID | RCC COV Rank | Norm COV Rank | Fold Change | T-test (p-value) | # Present | # Freq > 10 |
|---|---|---|---|---|---|---|---|---|
| AF051152 | toll-like receptor 2 | Hs.63668 | 3753 | 2841 | 2.5 | 4.824E−10 | 65 | 61 |
| AB006780 | lectin, galactoside-binding, soluble, 3 (galectin 3) | Hs.621 | 3123 | 2648 | 2.1 | 2.373E−09 | 65 | 65 |
| AF032886 | forkhead box O3A | Hs.14845 | 4751 | 2553 | 2.9 | 1.823E−07 | 65 | 63 |
| M64925 | membrane protein, palmitoylated 1 (55 kD) | Hs.1861 | 4885 | 3740 | 3.4 | 2.921E−07 | 65 | 65 |
| X12451 | cathepsin L | Hs.78056 | 4948 | 4959 | 3.5 | 1.053E−06 | 65 | 64 |
| D32143 | biliverdin reductase B (flavin reductase (NADPH)) | Hs.76289 | 4978 | 4946 | 3.8 | 1.176E−06 | 65 | 51 |
| AF079221 | BCL2/adenovirus E1B 19 kD-interacting protein 3-like | Hs.132955 | 4973 | 738 | 3.4 | 1.667E−06 | 65 | 65 |
| L76200 | guanylate kinase 1 | Hs.3764 | 4702 | 545 | 2.3 | 2.341E−06 | 65 | 65 |
| M25915 | clusterin (complement lysis inhibitor, SP-40, testosterone-repressed prostate message 2, apolipoprotein J) | Hs.75106 | 4671 | 2556 | 2.2 | 5.682E−06 | 65 | 65 |
| X12496 | glycophorin C (Gerbich blood group) | Hs.81994 | 4784 | 2756 | 2.3 | 8.074E−06 | 65 | 65 |
| L07648 | MAX-interacting protein 1 | Hs.118630 | 5017 | 3607 | 3.1 | 1.054E−05 | 65 | 65 |
| M24069 | cold shock domain protein A | Hs.198726 | 5080 | 1964 | 4.3 | 1.214E−05 | 65 | 62 |
| L07648 | MAX-interacting protein 1 | Hs.118630 | 4993 | 1677 | 2.7 | 1.961E−05 | 65 | 65 |
| D14874 | adrenomedullin | Hs.394 | 4945 | 4139 | 2.5 | 2.328E−05 | 65 | 64 |
| AL050254 | F-box protein 7 | Hs.5912 | 4969 | 39 | 2.3 | 4.875E−05 | 65 | 65 |
| X17644 | G1 to S phase transition 1 | Hs.2707 | 5068 | 1732 | 2.8 | 0.0001073 | 65 | 44 |
| AI565760 | ganglioside expression factor 2 | Hs.6518 | 4966 | 527 | 2.2 | 0.0001082 | 65 | 65 |
| V00505 | hemoglobin, delta | Hs.36977 | 5167 | 5070 | 6.4 | 0.0001176 | 65 | 58 |
| X79535 | tubulin, beta polypeptide | Hs.336780 | 4836 | 4393 | 2.0 | 0.0001308 | 65 | 41 |
| U76248 | seven in absentia (Drosophila) homolog 2 | Hs.20191 | 4982 | 395 | 2.1 | 0.0001703 | 65 | 62 |
| AB013382 | dual specificity phosphatase 6 | Hs.180383 | 4363 | 4916 | 3.2 | 2.665E−09 | 64 | 44 |
| AF025533 | leukocyte immunoglobulin-like receptor, subfamily B (with TM and ITIM domains), member 3 | Hs.105928 | 4281 | 3711 | 2.3 | 1.796E−07 | 64 | 62 |
| U05770 | annexin A5 | Hs.300711 | 3405 | 4405 | 2.1 | 1.998E−07 | 64 | 54 |
| X60364 | aminolevulinate, delta-, synthase 2 (sideroblastic/hypochromic anemia) | Hs.323383 | 5066 | 4919 | 6.8 | 7.041E−07 | 64 | 65 |
| AF001461 | core promoter element binding protein | Hs.285313 | 3489 | 5175 | 2.2 | 2.229E−05 | 64 | 62 |
| Z35491 | BCL2-associated athanogene | Hs.41714 | 5040 | 1910 | 2.6 | 8.933E−05 | 64 | 63 |
| D83664 | S100 calcium-binding protein A12 (calgranulin C) | Hs.19413 | 5048 | 4905 | 2.3 | 0.0005046 | 64 | 50 |
| L19185 | thioredoxin-dependent peroxide reductase 1 (thiol-specific antioxidant 1, natural killer-enhancing factor B) | Hs.146354 | 5130 | 4840 | 3.0 | 0.0005744 | 64 | 35 |
| M24470 | guanosine monophosphate reductase | Hs.1435 | 5095 | 4312 | 2.6 | 0.0006112 | 64 | 47 |
| X97324 | adipose differentiation-related protein; adipophilin | Hs.3416 | 5170 | 2819 | 3.6 | 0.0009168 | 64 | 64 |
| X52015 | interleukin 1 receptor antagonist | Hs.81134 | 4900 | 5136 | 4.1 | 1.249E−07 | 63 | 59 |
| AB008775 | aquaporin 9 | Hs.104624 | 4467 | 4955 | 2.5 | 6.609E−07 | 63 | 39 |
| J02973 | thrombomodulin | Hs.2030 | 4665 | 5035 | 2.1 | 6.829E−05 | 63 | 57 |
| D87116 | mitogen-activated protein kinase kinase 3 | Hs.180533 | 4377 | 4016 | 2.1 | 1.391E−06 | 62 | 65 |
| N74607 | ESTs, Highly similar to AQUAPORIN 3 [H. sapiens] | Hs.234642 | 4662 | 4739 | 0.4 | 0.0001043 | 62 | 50 |
| M36820 | GRO2 oncogene | Hs.75765 | 5077 | 5213 | 3.0 | 0.0002266 | 62 | 46 |
| M38690 | CD9 antigen (p24) | Hs.1244 | 4838 | 5074 | 2.0 | 0.0005439 | 62 | 26 |
| X90999 | hydroxyacyl glutathione hydrolase; glyoxalase 2 | Hs.155482 | 5138 | 4356 | 4.3 | 0.0001189 | 61 | 35 |
| M94856 | fatty acid binding protein 5 (psoriasis-associated) | Hs.153179 | 4992 | 5080 | 3.4 | 4.231E−06 | 60 | 31 |
| Z32684 | Kell blood group precursor (McLeod phenotype) | Hs.78919 | 4994 | 2026 | 3.0 | 7.435E−06 | 60 | 22 |
| AF061034 | tumor necrosis factor alpha-inducible protein with leucine zipper domains; Huntingtin interacting protein L | Hs.278898 | 4937 | 1223 | 2.5 | 1.229E−05 | 60 | 13 |
| J04102 | v-ets avian erythroblastosis virus E26 oncogene homolog 2 | Hs.85146 | 4668 | 4364 | 2.1 | 2.14E−05 | 60 | 27 |

TABLE 6-continued

184 DISEASE-ASSOCIATED TRANSCRIPTS IN RCC PATIENTS

| GenBank Accession Number | Gene Annotation | Unigene ID | RCC COV Rank | Norm COV Rank | Fold Change | T-test (p-value) | # Present | # Freq > 10 |
|---|---|---|---|---|---|---|---|---|
| L42542 | ralA binding protein 1 | Hs.75447 | 4795 | 3443 | 2.0 | 6.245E−05 | 60 | 17 |
| AE141349 | Tubulin, Beta | | 4864 | 5013 | 2.3 | 6.903E−05 | 60 | 29 |
| D38583 | S100 calcium-binding protein A11 (calgizzarin) | Hs.256290 | 4942 | 5084 | 2.4 | 0.0001294 | 60 | 45 |
| X04327 | 2,3-bisphosphoglycerate mutase | Hs.198365 | 5156 | 2762 | 3.4 | 0.0005919 | 60 | 19 |
| J04027 | ATPase, Ca++ transporting, plasma membrane 1 | Hs.78546 | 4590 | 4932 | 2.3 | 4.802E−06 | 59 | 38 |
| AF141349 | Tubulin, Beta | Hs.336780 | 5011 | 4590 | 2.5 | 8.725E−05 | 59 | 34 |
| Y00630 | plasminogen activator inhibitor, type II (arginine-serpin) | Hs.75716 | 5022 | 5214 | 2.7 | 0.0001986 | 59 | 59 |
| U29091 | selenium binding protein 1 | Hs.334841 | 5123 | 5032 | 6.9 | 1.249E−05 | 58 | 59 |
| U28389 | erythrocyte membrane protein band 4.9 (dematin) | Hs.274122 | 5102 | 3910 | 4.0 | 3.927E−05 | 58 | 65 |
| X64364 | basigin | Hs.74631 | 5093 | 1296 | 3.6 | 5.217E−05 | 58 | 53 |
| X00737 | nucleoside phosphorylase | Hs.75514 | 4507 | 5038 | 2.0 | 0.0001001 | 58 | 39 |
| M26683 | small inducible cytokine A2 (monocyte chemotactic protein 1, homologous to mouse Sig-je) | Hs.303649 | 5139 | 5215 | 6.6 | 3.159E−05 | 57 | 49 |
| AI349593 | hemoglobin, epsilon 1 | Hs.117848 | 5064 | 5121 | 3.0 | 8.566E−05 | 56 | 13 |
| L22075 | guanine nucleotide binding protein (G protein), alpha 13 | Hs.1666 | 3815 | 4953 | 2.2 | 1.35E−06 | 53 | 20 |
| AA135683 | brain acid-soluble protein 1 | Hs.79516 | 4198 | 4148 | 2.1 | 1.44E−06 | 53 | 32 |
| U00672 | interleukin 10 receptor, alpha | Hs.327 | 4277 | 4086 | 0.5 | 4.823E−05 | 53 | 54 |
| AL080235 | DKFZP586E1621 protein | Hs.35861 | 4889 | 3240 | 3.0 | 1.13E−06 | 52 | 23 |
| K00650 | v-fos FBJ murine osteosarcoma viral oncogene homolog | Hs.25647 | 5101 | 4029 | 0.5 | 0.0001975 | 52 | 55 |
| M28225 | small inducible cytokine A2 (monocyte chemotactic protein 1, homologous to mouse Sig-je) | Hs.303649 | 5155 | 5197 | 6.7 | 5.68E−05 | 51 | 37 |
| S78798 | Cluster Incl S78798: 1-phosphatidylinositol-4-phosphate 5-kinase isoform C [human, PBLs, mRNA, 1835 nt]. | Hs.108966 | 4875 | 665 | 2.5 | 4.123E−06 | 50 | 10 |
| AL049963 | *Homo sapiens* mRNA; cDNA DKFZp564A132 (from clone DKFZp564A132) | Hs.284205 | 4651 | 4155 | 2.2 | 6.76E−06 | 50 | 18 |
| L22005 | cell division cycle 34 | Hs.76932 | 5082 | 4185 | 3.5 | 4.315E−05 | 50 | 29 |
| K02401 | chorionic somatomammotropin hormone 1 (placental lactogen) | | 4673 | 4930 | 0.4 | 0.000423 | 50 | 36 |
| X14787 | thrombospondin 1 | Hs.87409 | 5001 | 5217 | 2.4 | 0.0004915 | 50 | 49 |
| X75042 | v-rel avian reticuloendotheliosis viral oncogene homolog | Hs.44313 | 2993 | 4933 | 2.3 | 5.819E−08 | 49 | 13 |
| AA131149 | S100 calcium-binding protein P | Hs.2962 | 4970 | 5115 | 2.4 | 0.0001709 | 49 | 35 |
| M35999 | integrin, beta 3 (platelet glycoprotein IIIa, antigen CD61) | Hs.87149 | 4908 | 4341 | 2.6 | 1.011E−05 | 48 | 23 |
| U21049 | epithelial protein up-regulated in carcinoma, membrane associated protein 17 | Hs.271473 | 4932 | 3123 | 2.3 | 3.94E−05 | 48 | 31 |
| M19267 | tropomyosin 1 (alpha) | Hs.77899 | 4904 | 2893 | 2.3 | 2E−05 | 47 | 11 |
| M27819 | solute carrier family 4, anion exchanger, member 1 | Hs.185923 | 5134 | 5216 | 7.5 | 1.725E−05 | 46 | 42 |
| M27492 | interleukin 1 receptor, type I | Hs.82112 | 4888 | 5142 | 2.4 | 9.826E−05 | 46 | 25 |
| X07834 | superoxide dismutase 2, mitochondrial | Hs.372783 | 4867 | 2075 | 2.5 | 3.956E−06 | 45 | 17 |
| X72308 | small inducible cytokine A7 (monocyte chemotactic protein 3) | Hs.251526 | 5075 | 5097 | 3.6 | 3.391E−05 | 45 | 26 |
| AI679353 | ESTs, Weakly similar to !!!! ALU CLASS E WARNING ENTRY !!!! [*H. sapiens*] | Hs.182611 | 5003 | 5154 | 2.5 | 0.0001701 | 45 | 14 |
| L42243 | interferon (alpha, beta and omega) receptor 2 | Hs.173936 | 4415 | 3824 | 2.1 | 2.471E−06 | 44 | 13 |
| D10925 | chemokine (C-C motif) receptor 1 | Hs.301921 | 4811 | 4666 | 2.5 | 5.121E−06 | 44 | 13 |
| D30783 | epiregulin | Hs.115263 | 4998 | 3590 | 3.1 | 5.694E−06 | 44 | 18 |
| S77763 | nuclear factor (erythroid-derived 2), 45 kD | Hs.75643 | 5124 | 2980 | 3.2 | 0.0002806 | 42 | 12 |
| X79535 | tubulin, beta polypeptide | | 4780 | 5120 | 2.6 | 5.817E−06 | 41 | 42 |
| U61836 | Human putative cyclin G1 interacting protein mRNA, partial sequence | Hs.92374 | 4788 | 4609 | 2.4 | 8.146E−06 | 41 | 14 |

TABLE 6-continued

184 DISEASE-ASSOCIATED TRANSCRIPTS IN RCC PATIENTS

| GenBank Accession Number | Gene Annotation | Unigene ID | RCC COV Rank | Norm COV Rank | Fold Change | T-test (p-value) | # Present | # Freq > 10 |
|---|---|---|---|---|---|---|---|---|
| M34480 | integrin, alpha 2b (platelet glycoprotein IIb of IIb/IIIa complex, antigen CD41B) | Hs.785 | 5029 | 5006 | 3.1 | 2.414E−05 | 39 | 30 |
| M63835 | Fc fragment of IgG, high affinity Ia, receptor for (CD64) | Hs.77424 | 4809 | 4285 | 2.1 | 3.916E−05 | 39 | 11 |
| AF017257 | v-ets avian erythroblastosis virus E26 oncogene homolog 2 | | 3987 | 897 | 2.1 | 3.459E−08 | 38 | 5 |
| AA527880 | NADH dehydrogenase (ubiquinone) 1 beta subcomplex, 7 (18 kD, B18) | Hs.661 | 5081 | 4675 | 3.7 | 3.306E−05 | 37 | 28 |
| AF065389 | tetraspan 5 | Hs.20709 | 5021 | 953 | 2.4 | 8.816E−05 | 37 | 11 |
| D86961 | lipoma HMGIC fusion partner-like 2 | Hs.79299 | 4939 | 2043 | 3.7 | 3.534E−07 | 35 | 12 |
| U61836 | Human putative cyclin G1 interacting protein mRNA, partial sequence | Hs.92374 | 5119 | 5156 | 4.2 | 7.33E−05 | 35 | 17 |
| AF026939 | interferon-induced protein with tetratricopeptide repeats 4 | Hs.181874 | 4750 | 4395 | 2.1 | 4.978E−05 | 34 | 14 |
| M25322 | selectin P (granule membrane protein 140 kD, antigen CD62) | Hs.73800 | 5133 | 2402 | 3.1 | 0.0004767 | 33 | 15 |
| AB007943 | KIAA0474 gene product | Hs.75151 | 5057 | 4196 | 3.3 | 2.149E−05 | 30 | 65 |
| M60298 | erythrocyte membrane protein band 4.2 | Hs.733 | 5179 | 3017 | 5.6 | 0.0003742 | 30 | 17 |
| X58851 | myosin, light polypeptide 4, alkali; atrial, embryonic | Hs.356717 | 5151 | 3371 | 4.0 | 0.0002666 | 29 | 12 |
| J05070 | matrix metalloproteinase 9 (gelatinase B, 92 kD gelatinase, 92 kD type IV collagenase) | Hs.151738 | 4778 | 2918 | 2.3 | 4.644E−06 | 28 | 6 |
| U43774 | Fc fragment of IgA, receptor for | Hs.193122 | 4777 | 4857 | 2.4 | 9.317E−06 | 27 | 10 |
| AF052111 | Homo sapiens clone 23953 mRNA sequence | Hs.21334 | 4215 | 3789 | 2.2 | 2.807E−07 | 26 | 2 |
| AA187563 | ESTs, Highly similar to CGI-56 protein [H. sapiens] | Hs.8836 | 4478 | 1311 | 2.2 | 3.825E−07 | 26 | 7 |
| H12458 | yj12d03.s1 Soares placenta Nb2HP Homo sapiens cDNA clone IMAGE: 148517 3' similar to WNT6 | | 4250 | 4652 | 2.1 | 4.07E−06 | 26 | 57 |
| Z23115 | BCL2-like 1 | Hs.305890 | 5086 | 5167 | 4.3 | 2.221E−05 | 26 | 22 |
| U12471 | Human thrombospondin-1 gene, partial cds | Hs.87409 | 5041 | 5030 | 2.9 | 5.46E−05 | 26 | 18 |
| L06895 | MAX dimerization protein | Hs.109012 | 4985 | 3015 | 2.3 | 8.798E−05 | 26 | 6 |
| AB023211 | peptidyl arginine deiminase, type II | Hs.33455 | 4936 | 4868 | 2.3 | 9.707E−05 | 26 | 8 |
| D63940 | MAX-interacting protein 1 | Hs.118630 | 5114 | 1391 | 3.9 | 7.286E−05 | 25 | 10 |
| X74039 | plasminogen activator, urokinase receptor | Hs.179657 | 5033 | 2574 | 2.8 | 4.169E−05 | 24 | 7 |
| AB018293 | KIAA0750 gene product | Hs.314434 | 5163 | 4386 | 4.9 | 0.0001921 | 24 | 17 |
| AA978353 | solute carrier family 1 (glutamate/neutral amino acid transporter), member 4 | Hs.374464 | 3351 | 1336 | 2.1 | 1.947E−09 | 23 | 3 |
| AJ243797 | three prime repair exonuclease 1 | Hs.278408 | 4915 | 5202 | 3.2 | 4.017E−06 | 23 | 15 |
| U89606 | pyridoxal (pyridoxine, vitamin B6) kinase | Hs.38041 | 5046 | 3734 | 2.4 | 0.0002111 | 23 | 8 |
| M19267 | tropomyosin 1 (alpha) | Hs.77899 | 4274 | 771 | 2.1 | 3.017E−07 | 22 | 8 |
| L35240 | enigma (LIM domain protein) | Hs.102948 | 3575 | 2807 | 2.1 | 3.028E−08 | 21 | 12 |
| AL096737 | Homo sapiens mRNA; cDNA DKFZp434F152(from clone DKFZp434F152) | Hs.5167 | 4814 | 4749 | 2.6 | 3.048E−06 | 19 | 64 |
| D14689 | nucleoporin 214 kD (CAIN) | Hs.170285 | 4623 | 4524 | 2.2 | 6.273E−06 | 19 | 46 |
| U36341 | solute carrier family 6 (neurotransmitter transporter, creatine), member 8 | Hs.187958 | 5032 | 3765 | 2.7 | 6.494E−05 | 19 | 28 |
| M77016 | tropomodulin | Hs.170453 | 5186 | 2442 | 4.9 | 0.0007758 | 19 | 11 |
| U91316 | cytosolic acyl coenzyme A thioester hydrolase | Hs.8679 | 4502 | 2737 | 2.1 | 1.898E−06 | 18 | 12 |
| M62896 | Human lipocortin (LIP) 2 pseudogene mRNA, complete cds-like region | Hs.348252 | 3841 | 3722 | 2.0 | 3.217E−07 | 17 | 4 |
| L40904 | peroxisome proliferative activated receptor, gamma | Hs.100724 | 5141 | 4460 | 6.1 | 4.033E−05 | 16 | 20 |
| U66359 | T54 protein | Hs.100391 | 4764 | 2450 | 4.3 | 5.444E−09 | 15 | 13 |
| W28931 | ESTs, Weakly similar to 38 kDa splicing factor [H. sapiens] | Hs.283976 | 4933 | 5232 | 4.0 | 1.143E−06 | 15 | 29 |

TABLE 6-continued

184 DISEASE-ASSOCIATED TRANSCRIPTS IN RCC PATIENTS

| GenBank Accession Number | Gene Annotation | Unigene ID | RCC COV Rank | Norm COV Rank | Fold Change | T-test (p-value) | # Present | # Freq > 10 |
|---|---|---|---|---|---|---|---|---|
| AB006537 | interleukin 1 receptor accessory protein | Hs.173880 | 4072 | 1425 | 2.1 | 5.561E−08 | 13 | 1 |
| U97067 | Cluster Incl U97067: *Homo sapiens* alpha-catenin-like protein mRNA, complete cds. | Hs.58488 | 4819 | 4961 | 2.3 | 2.571E−05 | 13 | 6 |
| U19599 | BCL2-associated X protein | Hs.159428 | 4039 | 4061 | 0.5 | 5.153E−05 | 13 | 6 |
| AA628946 | KH-type splicing regulatory protein (FUSE-binding protein 2) | Hs.91142 | 3189 | 4910 | 2.5 | 5.017E−09 | 12 | 44 |
| AI961220 | serine protease inhibitor, Kazal type 1 | Hs.181286 | 5035 | 2667 | 2.8 | 4.079E−05 | 12 | 4 |
| AL049250 | *Homo sapiens* mRNA; cDNA DKFZp564D113 (from clone DKFZp564D113) | Hs.356390 | 5027 | 3940 | 2.3 | 0.0002155 | 12 | 5 |
| AL031230 | aldehyde dehydrogenase 5 family, member A1 (succinate-semialdehyde dehydrogenase) | | 4830 | 1089 | 2.3 | 6.562E−06 | 11 | 3 |
| U68111 | protein phosphatase 1, regulatory (inhibitor) subunit 2 | | 4983 | 5109 | 3.0 | 1.282E−05 | 11 | 19 |
| AF035819 | macrophage receptor with collagenous structure | Hs.67726 | 4726 | 1966 | 2.6 | 4.175E−07 | 10 | 5 |
| AJ000480 | phosphoprotein regulated by mitogenic pathways | Hs.7837 | 4716 | 2979 | 2.2 | 5.308E−06 | 10 | 5 |
| U58917 | interleukin 17 receptor | Hs.129751 | 4674 | 2850 | 2.0 | 1.796E−05 | 10 | 1 |
| X90857 | Conserved gene telomeric to alpha globin cluster | Hs.19699 | 5074 | 2410 | 2.5 | 0.0003808 | 10 | 13 |
| J05500 | spectrin, beta, erythrocytic (includes sperocytosis, clinical type I) | Hs.47431 | 5122 | 4713 | 5.5 | 2.364E−05 | 9 | 17 |
| X54412 | collagen, type IX, alpha 1 | Hs.154850 | 5013 | 5050 | 2.5 | 0.0001267 | 9 | 28 |
| X75593 | RAB13, member RAS oncogene family | Hs.151536 | 4147 | 2502 | 2.3 | 2.116E−08 | 8 | 13 |
| D38037 | FK506-binding protein 1B (12.6 kD) | Hs.77643 | 4886 | 4835 | 2.2 | 0.0001298 | 8 | 2 |
| J02854 | myosin regulatory light chain 2, smooth muscle isoform | Hs.9615 | 5111 | 1099 | 3.3 | 0.0001603 | 8 | 7 |
| AF034209 | RIG-like 5-6 | Hs.166175 | 5042 | 3640 | 2.2 | 0.0004712 | 8 | 4 |
| U24578 | complement component 4A | | 5108 | 4896 | 2.7 | 0.0007918 | 8 | 15 |
| AB011161 | phosphatidylinositol-4-phosphate 5-kinase, type I, gamma | Hs.275182 | 4546 | 4539 | 2.9 | 3.707E−08 | 7 | 24 |
| L23959 | transcription factor Dp-1 | Hs.79353 | 4621 | 1087 | 2.0 | 8.135E−06 | 7 | 2 |
| M64788 | RAP1, GTPase activating protein 1 | Hs.75151 | 5153 | 1951 | 3.5 | 0.0004775 | 7 | 10 |
| X51362 | dopamine receptor D2 | Hs.73893 | 4781 | 5203 | 3.4 | 4.287E−07 | 6 | 21 |
| AB000520 | adaptor protein with pleckstrin homology and src homology 2 domains | Hs.105052 | 4462 | 1941 | 2.2 | 7.021E−07 | 6 | 3 |
| U43843 | Neuro-d4 (rat) homolog | Hs.159589 | 4124 | 4902 | 2.1 | 5.029E−06 | 6 | 5 |
| D43642 | transcription factor-like 1 | Hs.2430 | 3926 | 4299 | 2.3 | 4.473E−08 | 5 | 35 |
| W26700 | ESTs, Highly similar to brain specific Na+-dependent inorganic phosphate cotransporter [*R. norvegicus*] | Hs.6535 | 3942 | 4297 | 2.2 | 2.112E−07 | 5 | 5 |
| AA844998 | pancreatic polypeptide | Hs.184604 | 4324 | 4714 | 2.3 | 5.173E−07 | 5 | 11 |
| AJ223948 | RNA helicase family | Hs.48295 | 5034 | 1093 | 2.4 | 0.0001437 | 5 | 3 |
| AJ000644 | speckle-type POZ protein | Hs.129951 | 4924 | 2873 | 2.0 | 0.0001677 | 5 | 4 |
| W27095 | B7 protein | Hs.155586 | 4896 | 4612 | 0.5 | 0.0005773 | 5 | 29 |
| AF032108 | integrin, alpha7 | Hs.74369 | 3875 | 2021 | 2.0 | 8.428E−08 | 4 | 1 |
| M13207 | colony stimulating factor 2 (granulocyte-macrophage) | Hs.1349 | 4803 | 3030 | 2.9 | 3.338E−07 | 4 | 7 |
| AF059202 | diacylglycerol O-acyltransferase (mouse) homolog | Hs.288627 | 4782 | 4723 | 2.6 | 2.08E−06 | 4 | 10 |
| X82460 | hydroxyprostaglandin dehydrogenase 15-(NAD) | Hs.77348 | 4818 | 4170 | 2.3 | 1.647E−05 | 4 | 3 |
| AJ011712 | troponinT1, skeletal, slow | Hs.73980 | 4935 | 1426 | 2.0 | 0.0001917 | 4 | 2 |
| L37127 | polymerase (RNA) II (DNA directed) polypeptide J (13.3 kD) | Hs.80475 | 5104 | 1098 | 2.9 | 0.0002842 | 4 | 5 |
| AF089814 | tumor suppressor deleted in oral cancer-related 1 | Hs.355753 | 5038 | 2134 | 2.2 | 0.0003873 | 4 | 2 |

TABLE 6-continued

184 DISEASE-ASSOCIATED TRANSCRIPTS IN RCC PATIENTS

| GenBank Accession Number | Gene Annotation | Unigene ID | RCC COV Rank | Norm COV Rank | Fold Change | T-test (p-value) | # Present | # Freq > 10 |
|---|---|---|---|---|---|---|---|---|
| L07592 | peroxisome proliferative activated receptor, delta | Hs.106415 | 4163 | 4744 | 2.4 | 9.857E−08 | 3 | 18 |
| AB020644 | long fatty acyl-CoA synthetase 2 gene | Hs.14945 | 4424 | 4306 | 2.0 | 7.813E−06 | 3 | 4 |
| AF068706 | adaptor-related protein complex 1, gamma 2 subunit | Hs.343244 | 5113 | 1688 | 4.1 | 5.554E−05 | 3 | 12 |
| AF059198 | ER to nucleus signalling 1 | Hs.137575 | 4683 | 5101 | 2.1 | 0.0001249 | 3 | 17 |
| AF055027 | coactivator-associated arginine methyltransferase-1 | Hs.143696 | 4999 | 2921 | 2.1 | 0.0002883 | 3 | 6 |
| L03785 | myosin, light polypeptide 5, regulatory | Hs.170482 | 5154 | 3757 | 3.0 | 0.0009999 | 3 | 8 |
| X91348 | putative non-coding transcript (DiGeorge critical region 5) | Hs.335328 | 3774 | 2545 | 2.1 | 2.892E−08 | 2 | 1 |
| L32831 | G protein-coupled receptor 3 | Hs.66542 | 4578 | 5177 | 2.6 | 3.18E−06 | 2 | 18 |
| AI732885 | Human BRCA2 region, mRNA sequence CG011 | Hs.142907 | 4892 | 681 | 2.1 | 4.626E−05 | 2 | 2 |
| U96919 | inositol polyphosphate-4-phosphatase, type I, 107 kD | Hs.32944 | 5118 | 3038 | 3.2 | 0.0002322 | 2 | 7 |
| U62433 | cholinergic receptor, nicotinic, alpha polypeptide 4 | Hs.10734 | 5089 | 5189 | 2.8 | 0.0004996 | 2 | 9 |
| AF055000 | *H. sapiens* mRNA for unknown liver orphan | Hs.118463 | 4378 | 3305 | 2.5 | 5.537E−08 | 1 | 58 |
| J05581 | mucin 1, transmembrane | Hs.89603 | 4634 | 4942 | 2.7 | 4.138E−07 | 1 | 10 |
| U48213 | D site of albumin promoter (albumin D-box) binding protein | Hs.155402 | 4812 | 3542 | 0.4 | 1.723E−06 | 1 | 32 |
| D45421 | phosphodiesterase I/nucleotide pyrophosphatase 2 (autotaxin) | Hs.174185 | 4753 | 2549 | 2.4 | 2.976E−06 | 1 | 4 |
| AF017786 | Phosphatidic acid phosphatase type 2b | Hs.173717 | 4679 | 680 | 2.1 | 5.747E−06 | 1 | 3 |
| AB010419 | core-binding factor, runt domain, alpha subunit 2; translocated to, 3 | Hs.110099 | 5065 | 3641 | 3.4 | 2.068E−05 | 1 | 11 |
| AF070587 | *Homo sapiens* clone 24741 mRNA sequence | Hs.25770 | 4869 | 4801 | 2.2 | 6.352E−05 | 1 | 13 |
| AJ001481 | double homeobox, 1 | Hs.274469 | 5004 | 2922 | 2.5 | 6.436E−05 | 1 | 7 |
| U70732 | glutamic-pyruvate transaminase (alanine aminotransferase) | Hs.103502 | 4512 | 5163 | 2.1 | 0.000245 | 1 | 24 |
| AF038171 | Cluster Incl AF038171: *Homo sapiens* clone 23671 mRNA sequence. | | 5059 | 1096 | 2.3 | 0.0002938 | 1 | 3 |
| AF070629 | RAB2, member RAS oncogene family | Hs.78305 | 5020 | 1967 | 2.1 | 0.0003503 | 1 | 3 |
| L17330 | pre-T/NK cell associated protein | Hs.280 | 5044 | 1094 | 2.2 | 0.0003682 | 1 | 3 |
| AI077476 | KIAA0353 protein | Hs.10587 | 5053 | 3147 | 2.3 | 0.0004087 | 1 | 7 |
| AF054185 | proteasome (prosome, macropain) subunit, alpha type, 7 | Hs.233952 | 4963 | 5009 | 2.1 | 0.0005972 | 1 | 15 |
| U18548 | G protein-coupled receptor 12 | Hs.123034 | 5062 | 1097 | 2.1 | 0.0008125 | 1 | 2 |

TABLE 7

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| AF051152 | toll-like receptor 2 | 45 | 20 | 45 | 16 | Activated T Cells |
| AB006780 | lectin, galactoside-binding, soluble, 3 (galectin 3) | 45 | 20 | 45 | 20 | |
| AF032886 | forkhead box O3A | 45 | 20 | 45 | 18 | |
| M64925 | membrane protein, palmitoylated 1 (55 kD) | 45 | 20 | 45 | 20 | |
| X12451 | cathepsin L | 45 | 20 | 45 | 19 | Activated T Cells |
| D32143 | biliverdin reductase B (flavin reductase (NADPH)) | 45 | 20 | 44 | 7 | |

TABLE 7-continued

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| AF079221 | BCL2/adenovirus E1B 19 kD-interacting protein 3-like | 45 | 20 | 45 | 20 | |
| L76200 | guanylate kinase 1 | 45 | 20 | 45 | 20 | |
| M25915 | clusterin (complement lysis inhibitor, SP-40, testosterone-repressed prostate message 2, apolipoprotein J) | 45 | 20 | 45 | 20 | |
| X12496 | glycophorin C (Gerbich blood group) | 45 | 20 | 45 | 20 | |
| L07648 | MAX-interacting protein 1 | 45 | 20 | 45 | 20 | |
| M24069 | cold shock domain protein A | 45 | 20 | 45 | 17 | |
| L07648 | MAX-interacting protein 1 | 45 | 20 | 45 | 20 | |
| D14874 | adrenomedullin | 45 | 20 | 45 | 19 | |
| AL050254 | F-box protein 7 | 45 | 20 | 45 | 20 | |
| X17644 | G1 to S phase transition 1 | 45 | 20 | 35 | 9 | Activated T Cells |
| AI565760 | ganglioside expression factor 2 | 45 | 20 | 45 | 20 | |
| V00505 | hemoglobin, delta | 45 | 20 | 43 | 15 | Renal failure |
| X79535 | tubulin, beta polypeptide | 45 | 20 | 34 | 7 | |
| U76248 | seven in absentia (Drosophila) homolog 2 | 45 | 20 | 43 | 19 | |
| AB013382 | dual specificity phosphatase 6 | 45 | 19 | 40 | 4 | |
| AF025533 | leukocyte immunoglobulin-like receptor, subfamily B (with TM and ITIM domains), member 3 | 44 | 20 | 44 | 18 | |
| U05770 | annexin A5 | 45 | 19 | 43 | 11 | |
| X60364 | aminolevulinate, delta-, synthase 2 (sideroblastic/hypochromic anemia) | 45 | 19 | 45 | 20 | Renal failure |
| AF001461 | core promoter element binding protein | 45 | 19 | 45 | 17 | |
| Z35491 | BCL2-associated athanogene | 44 | 20 | 44 | 19 | |
| D83664 | S100 calcium-binding protein A12 (calgranulin C) | 44 | 20 | 37 | 13 | |
| L19185 | thioredoxin-dependent peroxide reductase 1 (thiol-specific antioxidant 1, natural killer-enhancing factor B) | 45 | 19 | 31 | 4 | |
| M24470 | guanosine monophosphate reductase | 44 | 20 | 34 | 13 | |
| X97324 | adipose differentiation-related protein; adipophilin | 44 | 20 | 44 | 20 | |
| X52015 | interleukin 1 receptor antagonist | 44 | 19 | 44 | 15 | Activated T Cells |
| AB008775 | aquaporin 9 | 44 | 19 | 33 | 6 | |
| J02973 | thrombomodulin | 44 | 19 | 43 | 14 | |
| D87116 | mitogen-activated protein kinase kinase 3 | 44 | 18 | 45 | 20 | |
| N74607 | ESTs, Highly similar to AQUAPORIN 3 [*H. sapiens*] | 42 | 20 | 30 | 20 | Activated T Cells |
| M36820 | GRO2 oncogene | 43 | 19 | 36 | 10 | |
| M38690 | CD9 antigen (p24) | 44 | 18 | 23 | 3 | |
| X90999 | hydroxyacyl glutathione hydrolase; glyoxalase 2 | 44 | 17 | 31 | 4 | |
| M94856 | fatty acid binding protein 5 (psoriasis-associated) | 42 | 18 | 28 | 3 | Activated T Cells |
| Z32684 | Kell blood group precursor (McLeod phenotype) | 41 | 19 | 22 | 0 | |
| AF061034 | tumor necrosis factor alpha-inducible protein with leucine zipper domains; Huntingtin interacting protein L | 44 | 16 | 13 | 0 | |
| J04102 | v-ets avian erythroblastosis virus E26 oncogene homolog 2 | 41 | 19 | 25 | 2 | |
| L42542 | ralA binding protein 1 | 42 | 18 | 17 | 0 | |
| AF141349 | Tubulin, Beta | 43 | 17 | 25 | 4 | Activated T Cells |
| D38583 | S100 calcium-binding protein A11 (calgizzarin) | 40 | 20 | 33 | 12 | |
| X04327 | 2,3-bisphosphoglycerate mutase | 42 | 18 | 18 | 1 | |
| J04027 | ATPase, Ca++ transporting, plasma membrane 1 | 43 | 16 | 33 | 5 | |

TABLE 7-continued

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| AF141349 | Tubulin, Beta | 43 | 16 | 29 | 5 | Activated T Cells |
| Y00630 | plasminogen activator inhibitor, type II (arginine-serpin) | 41 | 18 | 42 | 17 | |
| U29091 | selenium binding protein 1 | 44 | 14 | 44 | 15 | |
| U28389 | erythrocyte membrane protein band 4.9 (dematin) | 43 | 15 | 45 | 20 | |
| X64364 | basigin | 43 | 15 | 43 | 10 | |
| X00737 | nucleoside phosphorylase | 43 | 15 | 34 | 5 | Activated T Cells |
| M26683 | small inducible cytokine A2 (monocyte chemotactic protein 1, homologous to mouse Sig-je) | 40 | 17 | 37 | 12 | |
| AI349593 | hemoglobin, epsilon 1 | 42 | 14 | 13 | 0 | |
| L22075 | guanine nucleotide binding protein (G protein), alpha 13 | 41 | 12 | 19 | 1 | |
| AA135683 | brain acid-soluble protein 1 | 39 | 14 | 29 | 3 | |
| U00672 | interleukin 10 receptor, alpha | 33 | 20 | 34 | 20 | |
| AL080235 | DKFZP586E1621 protein | 41 | 11 | 23 | 0 | |
| K00650 | v-fos FBJ murine osteosarcoma viral oncogene homolog | 32 | 20 | 35 | 20 | Activated T Cells |
| M28225 | small inducible cytokine A2 (monocyte chemotactic protein 1, homologous to mouse Sig-je) | 36 | 15 | 34 | 3 | |
| S78798 | Cluster Incl S78798: 1-phosphatidylinositol-4-phosphate 5-kinase isoform C [human, PBLs, mRNA, 1835 nt]. | 39 | 11 | 10 | 0 | |
| AL049963 | *Homo sapiens* mRNA; cDNA DKFZp564A132 (from clone DKFZp564A132) | 38 | 12 | 17 | 1 | Renal failure |
| L22005 | cell division cycle 34 | 38 | 12 | 27 | 2 | |
| K02401 | chorionic somatomammotropin hormone 1 (placental lactogen) | 30 | 20 | 17 | 19 | |
| X14787 | thrombospondin 1 | 38 | 12 | 39 | 10 | |
| X75042 | v-rel avian reticuloendotheliosis viral oncogene homolog | 35 | 14 | 12 | 1 | |
| AA131149 | S100 calcium-binding protein P | 35 | 14 | 30 | 5 | |
| M35999 | integrin, beta 3 (platelet glycoprotein IIIa, antigen CD61) | 36 | 12 | 22 | 1 | |
| U21049 | epithelial protein up-regulated in carcinoma, membrane associated protein 17 | 37 | 11 | 28 | 3 | |
| M19267 | tropomyosin 1 (alpha) | 36 | 11 | 11 | 0 | |
| M27819 | solute carrier family 4, anion exchanger, member 1 | 40 | 6 | 40 | 2 | Renal failure |
| M27492 | interleukin 1 receptor, type I | 36 | 10 | 21 | 4 | Activated T Cells |
| X07834 | superoxide dismutase 2, mitochondrial | 36 | 9 | 17 | 0 | |
| X72308 | small inducible cytokine A7 (monocyte chemotactic protein 3) | 35 | 10 | 24 | 2 | |
| AI679353 | ESTs, Weakly similar to !!!! ALU CLASS E WARNING ENTRY !!!! [*H. sapiens*] | 37 | 8 | 13 | 1 | |
| L42243 | interferon (alpha, beta and omega) receptor 2 | 36 | 8 | 13 | 0 | |
| D10925 | chemokine (C-C motif) receptor 1 | 35 | 9 | 13 | 0 | |
| D30783 | epiregulin | 35 | 9 | 18 | 0 | |
| S77763 | nuclear factor (erythroid-derived 2), 45 kD | 36 | 6 | 12 | 0 | |
| X79535 | tubulin, beta polypeptide | 33 | 8 | 36 | 6 | Renal failure & Activated T Cells |
| U61836 | Human putative cyclin G1 interacting protein mRNA, partial sequence | 33 | 8 | 14 | 0 | |

TABLE 7-continued

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| M34480 | integrin, alpha 2b (platelet glycoprotein IIb of IIb/IIIa complex, antigen CD41B) | 33 | 6 | 27 | 3 | |
| M63835 | Fc fragment of IgG, high affinity Ia, receptor for (CD64) | 28 | 11 | 11 | 0 | |
| AF017257 | v-ets avian erythroblastosis virus E26 oncogene homolog 2 | 32 | 6 | 5 | 0 | |
| AA527880 | NADH dehydrogenase (ubiquinone) 1 beta subcomplex, 7 (18 kD, B18) | 24 | 13 | 26 | 2 | Renal failure |
| AF065389 | tetraspan 5 | 29 | 8 | 11 | 0 | |
| D86961 | lipoma HMGIC fusion partner-like 2 | 31 | 4 | 12 | 0 | Renal failure |
| U61836 | Human putative cyclin G1 interacting protein mRNA, partial sequence | 29 | 6 | 16 | 1 | |
| AF026939 | interferon-induced protein with tetratricopeptide repeats 4 | 25 | 9 | 14 | 0 | |
| M25322 | selectin P (granule membrane protein 140 kD, antigen CD62) | 27 | 6 | 15 | 0 | |
| AB007943 | KIAA0474 gene product | 24 | 6 | 45 | 20 | |
| M60298 | erythrocyte membrane protein band 4.2 | 28 | 2 | 17 | 0 | |
| X58851 | myosin, light polypeptide 4, alkali; atrial, embryonic | 26 | 3 | 12 | 0 | |
| J05070 | matrix metalloproteinase 9 (gelatinase B, 92 kD gelatinase, 92 kD type IV collagenase) | 24 | 4 | 6 | 0 | |
| U43774 | Fc fragment of IgA, receptor for | 24 | 3 | 10 | 0 | |
| AF052111 | Homo sapiens clone 23953 mRNA sequence | 19 | 7 | 2 | 0 | |
| AA187563 | ESTs, Highly similar to CGI-56 protein [H. sapiens] | 23 | 3 | 7 | 0 | |
| H12458 | yj12d03.s1 Soares placenta Nb2HP Homo sapiens cDNA clone IMAGE: 148517 3' similar to WNT6 | 18 | 8 | 41 | 16 | |
| Z23115 | BCL2-like 1 | 25 | 1 | 21 | 1 | Activated T Cells |
| U12471 | Human thrombospondin-1 gene, partial cds | 23 | 3 | 17 | 1 | |
| L06895 | MAX dimerization protein | 18 | 8 | 6 | 0 | |
| AB023211 | peptidyl arginine deiminase, type II | 18 | 8 | 8 | 0 | |
| D63940 | MAX-interacting protein 1 | 24 | 1 | 10 | 0 | |
| X74039 | plasminogen activator, urokinase receptor | 21 | 3 | 7 | 0 | |
| AB018293 | KIAA0750 gene product | 23 | 1 | 17 | 0 | |
| AA978353 | solute carrier family 1 (glutamate/neutral amino acid transporter), member 4 | 21 | 2 | 3 | 0 | |
| AJ243797 | three prime repair exonuclease 1 | 13 | 10 | 14 | 1 | Activated T Cells |
| U89606 | pyridoxal (pyridoxine, vitamin B6) kinase | 20 | 3 | 8 | 0 | |
| M19267 | tropomyosin 1 (alpha) | 20 | 2 | 8 | 0 | |
| L35240 | enigma (LIM domain protein) | 17 | 4 | 12 | 0 | |
| AL096737 | Homo sapiens mRNA; cDNA DKFZp434F152 (from clone DKFZp434F152) | 11 | 8 | 44 | 20 | |
| D14689 | nucleoporin 214 kD (CAIN) | 15 | 4 | 37 | 9 | |
| U36341 | solute carrier family 6 (neurotransmitter transporter, creatine), member 8 | 19 | 0 | 26 | 2 | Renal failure |
| M77016 | tropomodulin | 19 | 0 | 11 | 0 | |
| U91316 | cytosolic acyl coenzyme A thioester hydrolase | 17 | 1 | 12 | 0 | |
| M62896 | Human lipocortin (LIP) 2 pseudogene mRNA, complete cds-like region | 15 | 2 | 4 | 0 | |
| L40904 | peroxisome proliferative activated receptor, gamma | 15 | 1 | 20 | 0 | |
| U66359 | T54 protein | 15 | 0 | 13 | 0 | |

TABLE 7-continued

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| W28931 | ESTs, Weakly similar to 38 kDa splicing factor [*H. sapiens*] | 12 | 3 | 27 | 2 | |
| AB006537 | interleukin 1 receptor accessory protein | 11 | 2 | 1 | 0 | |
| U97067 | Cluster Incl U97067: *Homo sapiens* alpha-catenin-like protein mRNA, complete cds. | 12 | 1 | 6 | 0 | |
| U19599 | BCL2-associated X protein | 4 | 9 | 1 | 5 | |
| AA628946 | KH-type splicing regulatory protein (FUSE-binding protein 2) | 9 | 3 | 39 | 5 | |
| AI961220 | serine protease inhibitor, Kazal type 1 | 12 | 0 | 4 | 0 | |
| AL049250 | *Homo sapiens* mRNA; cDNA DKFZp564D113 (from clone DKFZp564D113) | 11 | 1 | 5 | 0 | |
| AL031230 | aldehyde dehydrogenase 5 family, member A1 (succinate-semialdehyde dehydrogenase) | 11 | 0 | 3 | 0 | |
| U68111 | protein phosphatase 1, regulatory (inhibitor) subunit 2 | 10 | 1 | 18 | 1 | |
| AF035819 | macrophage receptor with collagenous structure | 10 | 0 | 5 | 0 | |
| AJ000480 | phosphoprotein regulated by mitogenic pathways | 9 | 1 | 5 | 0 | |
| U58917 | interleukin 17 receptor | 8 | 2 | 1 | 0 | |
| X90857 | Conserved gene telomeric to alpha globin cluster | 10 | 0 | 13 | 0 | |
| J05500 | spectrin, beta, erythrocytic (includes sperocytosis, clinical type I) | 9 | 0 | 17 | 0 | |
| X54412 | collagen, type IX, alpha 1 | 8 | 1 | 24 | 4 | |
| X75593 | RAB13, member RAS oncogene family | 8 | 0 | 13 | 0 | |
| D38037 | FK506-binding protein 1B (12.6 kD) | 7 | 1 | 2 | 0 | |
| J02854 | myosin regulatory light chain 2, smooth muscle isoform | 8 | 0 | 7 | 0 | |
| AF034209 | RIG-like 5-6 | 7 | 1 | 4 | 0 | |
| U24578 | complement component 4A | 8 | 0 | 14 | 1 | |
| AB011161 | phosphatidylinositol-4-phosphate 5-kinase, type I, gamma | 5 | 2 | 24 | 0 | Renal failure |
| L23959 | transcription factor Dp-1 | 6 | 1 | 2 | 0 | |
| M64788 | RAP1, GTPase activating protein 1 | 7 | 0 | 10 | 0 | |
| X51362 | dopamine receptor D2 | 6 | 0 | 20 | 1 | |
| AB000520 | adaptor protein with pleckstrin homology and src homology 2 domains | 6 | 0 | 3 | 0 | |
| U43843 | Neuro-d4 (rat) homolog | 6 | 0 | 5 | 0 | |
| D43642 | transcription factor-like 1 | 5 | 0 | 34 | 1 | |
| W26700 | ESTs, Highly similar to brain specific Na+-dependent inorganic phosphate cotransporter [*R. norvegicus*] | 5 | 0 | 5 | 0 | |
| AA844998 | pancreatic polypeptide | 5 | 0 | 11 | 0 | |
| AJ223948 | RNA helicase family | 5 | 0 | 3 | 0 | |
| AJ000644 | speckle-type POZ protein | 4 | 1 | 4 | 0 | |
| W27095 | B7 protein | 3 | 2 | 13 | 16 | |
| AF032108 | integrin, alpha 7 | 4 | 0 | 1 | 0 | |
| M13207 | colony stimulating factor 2 (granulocyte-macrophage) | 4 | 0 | 7 | 0 | |
| AF059202 | diacylglycerol O-acyltransferase (mouse) homolog | 3 | 1 | 10 | 0 | |
| X82460 | hydroxyprostaglandin dehydrogenase 15-(NAD) | 3 | 1 | 3 | 0 | |
| AJ011712 | troponin T1, skeletal, slow | 4 | 0 | 2 | 0 | |
| L37127 | polymerase (RNA) II (DNA directed) polypeptide J (13.3 kD) | 4 | 0 | 5 | 0 | |
| AF089814 | tumor suppressor deleted in oral cancer-related 1 | 3 | 1 | 2 | 0 | |

TABLE 7-continued

184 DISEASE-ASSOCIATED TRANSCRIPTS IN RCC PATIENTS

| GenBank Accession Number | Gene Annotation | # Present RCC | # Present Normal | # Freq > 10 RCC | # Freq > 10 Normal | Common with |
|---|---|---|---|---|---|---|
| L07592 | peroxisome proliferative activated receptor, delta | 2 | 1 | 18 | 0 | |
| AB020644 | long fatty acyl-CoA synthetase 2 gene | 2 | 1 | 4 | 0 | |
| AF068706 | adaptor-related protein complex 1, gamma 2 subunit | 3 | 0 | 12 | 0 | |
| AF059198 | ER to nucleus signalling 1 | 2 | 1 | 16 | 1 | |
| AF055027 | coactivator-associated arginine methyltransferase-1 | 3 | 0 | 6 | 0 | |
| L03785 | myosin, light polypeptide 5, regulatory | 1 | 2 | 8 | 0 | |
| X91348 | putative non-coding transcript (DiGeorge critical region 5) | 2 | 0 | 1 | 0 | |
| L32831 | G protein-coupled receptor 3 | 1 | 1 | 16 | 2 | |
| AI732885 | Human BRCA2 region, mRNA sequence CG011 | 2 | 0 | 2 | 0 | |
| U96919 | inositol polyphosphate-4-phosphatase, type I, 107 kD | 2 | 0 | 7 | 0 | |
| U62433 | cholinergic receptor, nicotinic, alpha polypeptide 4 | 2 | 0 | 8 | 1 | |
| AF055000 | *H. sapiens* mRNA for unknown liver orphan | 1 | 0 | 43 | 15 | |
| J05581 | mucin 1, transmembrane | 1 | 0 | 10 | 0 | |
| U48213 | D site of albumin promoter (albumin D-box) binding protein | 1 | 0 | 14 | 18 | |
| D45421 | phosphodiesterase I/nucleotide pyrophosphatase 2 (autotaxin) | 0 | 1 | 4 | 0 | |
| AF017786 | Phosphatidic acid phosphatase type 2b | 1 | 0 | 3 | 0 | |
| AB010419 | core-binding factor, runt domain, alpha subunit 2; translocated to, 3 | 1 | 0 | 11 | 0 | |
| AF070587 | *Homo sapiens* clone 24741 mRNA sequence | 1 | 0 | 13 | 0 | |
| AJ001481 | double homeobox, 1 | 1 | 0 | 7 | 0 | |
| U70732 | glutamic-pyruvate transaminase (alanine aminotransferase) | 1 | 0 | 22 | 2 | |
| AF038171 | Cluster Incl AF038171: *Homo sapiens* clone 23671 mRNA sequence. | 1 | 0 | 3 | 0 | |
| AF070629 | RAB2, member RAS oncogene family | 0 | 1 | 3 | 0 | |
| L17330 | pre-T/NK cell associated protein | 1 | 0 | 3 | 0 | |
| AI077476 | KIAA0353 protein | 1 | 0 | 7 | 0 | |
| AF054185 | proteasome (prosome, macropain) subunit, alpha type, 7 | 1 | 0 | 13 | 2 | |
| U18548 | G protein-coupled receptor 12 | 1 | 0 | 2 | 0 | |

Example 5

Probing the Molecular Basis of the RCC Disease Gene Classification Set in PBMCs

The expression profiles in RCC PBMCs were compared with profiles in RCC primary tumors. In these experiments the difference averages (rather than standard-curve normalized frequencies) of the 20 normal PBMCs and 45 RCC PBMCs from the present study were normalized using the GeneLogic GLGC normalization algorithm with difference averages detected in expression profiles of 57 normal kidney biopsies and 43 RCC tumor tissue biopsies. The expression profiles of normal kidney and primary RCC tumor tissues were downloaded in silico from the BioExpress database (Genelogic, Giathersburg Md.). To identify any genes induced in both RCC PBMCs and RCC tumor tissue relative to normal controls, gene expression values for the 165 arrays were clustered according to the method of Eisen et al., Proc. Nat. Acad. Sci., U.S.A., 95: 14863-14868 (1998). In these analyses only genes were clustered and the original order of the arrays as depicted was conserved in order to visually detect batteries of genes with patterns of regulation consistent with RCC tumor markers present in RCC peripheral blood.

Expression profiles in RCC PBMCs were also compared with profiles in PHA-stimulated PBMCs ex vivo. In these experiments the expression profiles of 20 normal PBMCs and 45 RCC PBMCs were compared to expression profiles detected in (n=3) untreated or 6h PHA-stimulated PBMCs cultured ex vivo. Normalization using a standard curve to generate frequencies was performed, and hierarchical clustering of genes was subsequently performed.

In addition, the expression profiles in RCC PBMCs were compared with profiles in PBMCs from non-RCC patients with renal failure. The difference averages of the 20 normal PBMCs and 45 RCC PBMCs were normalized using the GeneLogic GLGC normalization algorithm with difference averages detected in expression profiles of 8 non-RCC renal failure PBMCs downloaded in silico from the BioExpress database (Genelogic, Giathersburg Md.). Hierarchical clustering of genes only was subsequently performed.

Furthermore, the 184 RCC disease genes listed in Tables 6 and 7 were compared to the 10 transcripts most strongly up-regulated in RCC tumors (n=47) relative to normal kidney tissue (n=60) using profiles downloaded from the Bioexpress Database (GeneLogic, Gaithersburg Md.). The RCC tumor-specific transcripts that possessed the highest average fold differences in expression between RCC tumor tissue and normal kidney were unchanged between normal and RCC PBMCs, suggesting that shed RCC tumor cells did not contribute significantly to the disease-associated transcripts identified in PBMCs isolated from RCC patients.

The 184 RCC disease genes listed in Tables 6 and 7 were also compared to genes differentially expressed between unstimulated $CD4^+$ T cells (n=3 normal donors) and $CD4^+$ T cells (n=3 normal donors) stimulated ex vivo with anti-CD3 and anti-CD28 in culture. Stimulated $CD4^+$ T cells possessed 14 transcripts that were greater than 2-fold changed in the same direction (induced or repressed) as the disease-associated transcripts in RCC PBMCs, as indicated in the last column of Table 7.

The 184 RCC disease genes listed in Tables 6 and 7 were further compared to genes differentially expressed between PBMCs from non-RCC end-stage renal failure patients (n=9 individuals) and PBMCs from normal volunteers (n=4 individuals). Of these, 9 transcripts differentially expressed in PBMCs from renal failure patients were also disease associated transcripts in RCC PBMCs, as indicated in the last column of Table 7. Thus, the 184 RCC disease genes listed in Tables 6 and 7 contain a subset of markers commonly involved in immune responses measured ex vivo ($CD4^+$ T cell activation) and in responses of circulating leukocytes to renal dysfunction observed in vivo. Without limiting the present invention to any particular theory, these results support a hypothesis that the expression levels of at least a subset of the disease-associated genes observed in RCC PBMCs may result from an activation of circulating T cells and/or other leukocytes in response to the presence of the tumor. In addition, it is possible that the regulation of another subset of disease-associated transcripts detected in RCC PBMCs may be due to alterations in leukocyte expression profiles in response to renal dysfunction in the RCC patients.

Example 6

Classification of RCC and RCC-Free Status Using Gene Expression Profiles in Peripheral Blood Cells To build and train the RCC disease classifiers, 70% of the RCC PBMC expression patterns (n=31) and 70% of the disease-free PBMC expression patterns (n=14) were randomly selected and used as the training set. The remaining RCC and disease-free PBMC expression patterns were used as the test set. A relative class separation metric was used to calculate a measure of correlation and rank order the genes with expression levels most highly correlated with the classification vector characteristic of the training set. This measure of correlation is composed of mean expression values and variances.

Classification of the test set of samples was performed using a weighted voting method to classify the remaining PBMC expression profiles as characteristic of RCC or disease-free PBMCs. In this method the expression level of each gene in the classifier set contributes to an overall prediction strength which determines the classification of the sample. The prediction strength in this example is essentially a combined variable that indicates the number of "votes" for either one class or another, and can vary between 0 (narrow margin of victory) and 1 (wide margin of victory) in favor of the predicted class. To quantitate the accuracy of this prediction method, a value of 0.3 was imposed as the prediction strength threshold above which calls could confidently be made.

In this example, the accuracy of prediction for any given classifier gene set is defined as the percentage of calls with prediction strengths greater than 0.3 that also classifies samples correctly. The class predictors used in this example include (1) a 2-gene class predictor consisting of TLR2 and EEF1A2, (2) a 4-gene class predictor consisting of TLR2, LGALS3, EEF1A2, and BRF2, (3) a 6-gene class predictor consists of TLR2, LGALS3, DKFZP586E1621, EEF1A2, BRF2, and SNRPG, (4) an 8-gene class predictor consists of TLR2, LGALS3, DKFZP586E1621, SOD2, EEF1A2, BRF2, SNRPG, and NUMA1, (5) a 10-gene class predictor consists of TLR2, LGALS3, DKFZP586E1621, SOD2, DUSP6, EEF1A2, BRF2, SNRPG, NUMA1, and AKR1B1, (6) a 12-gene class predictor consists of TLR2, LGALS3, DKFZP586E1621, SOD2, DUSP6, KIAA0669, EEF1A2, BRF2, SNRPG, NUMA1, AKR1B1, and SMARCE1, (7) a 14gene class predictor consists of TLR2, LGALS3, DKFZP586E1621, SOD2, DUSP6, KIAA0669, IL1RN, EEF1A2, BRF2, SNRPG, NUMA1, AKR1B1, SMARCE1, and MSF, (8) a 16-gene class predictor consists of TLR2, LGALS3, DKFZP586E1621, SOD2, DUSP6, KIAA0669, IL1RN, KIAA0410, EEF1A2, BRF2, SNRPG, NUMA1, AKR1B1, SMARCE1, MSF, and PTMA, (9) an 18-gene class predictor consists of TLR2, LGALS3, DKFZP586E1621, SOD2, DUSP6, KIAA0669, IL1RN, KIAA0410, T54, EEF1A2, BRF2, SNRPG, NUMA1, AKR1B1, SMARCE1, MSF, PTMA, and PSMD3, and (10) a 20-gene class predictor consists of EEF1A2, TLR2, BRF2, LGALS3, SNRPG, DKFZP586E1621, NUMA1, SOD2, AKR1B1, DUSP6, SMARCE1, KIAA0669, MSF, IL1RN, PTMA, KIAA0410, PSMD3, T54, C1QBP, and OSR1.

The accuracy of prediction for both the training sets and the test sets of RCC PBMCs with each set of predictor genes was calculated. Calculating the accuracy of classification for a training set indicates how uniformly the predictor gene set was positively correlated with each individual sample in the training set, whereas calculating the accuracy of prediction for a test set indicates how well the expression of this gene set predicted the identity of individual samples in an "unknown" group. Table 8 illustrated the accuracy of prediction with each of the above-described class predictors. Classifier gene sets using 10 or more genes in the weighted voting algorithm yielded 100% accuracy in prediction of the test set. These studies demonstrate the feasibility of performing simple pairwise prediction of RCC versus RCC-free status using expression patterns found in a limited number of gene transcripts in the compartment of peripheral blood.

TABLE 8

Prediction Accuracy of the Class Predictors of the Present Invention

| Genes in the Class Predictor | Prediction Accuracy for Training Set (%) | Prediction Accuracy for Test Set (%) |
| --- | --- | --- |
| 2 | 71.88 | 100.00 |
| 4 | 75.00 | 92.31 |
| 6 | 82.76 | 90.91 |
| 8 | 88.89 | 84.62 |
| 10 | 92.59 | 100.00 |
| 12 | 92.59 | 100.00 |
| 14 | 93.10 | 100.00 |
| 16 | 92.86 | 100.00 |
| 18 | 93.10 | 100.00 |
| 20 | 92.86 | 100.00 |

Figure 3:
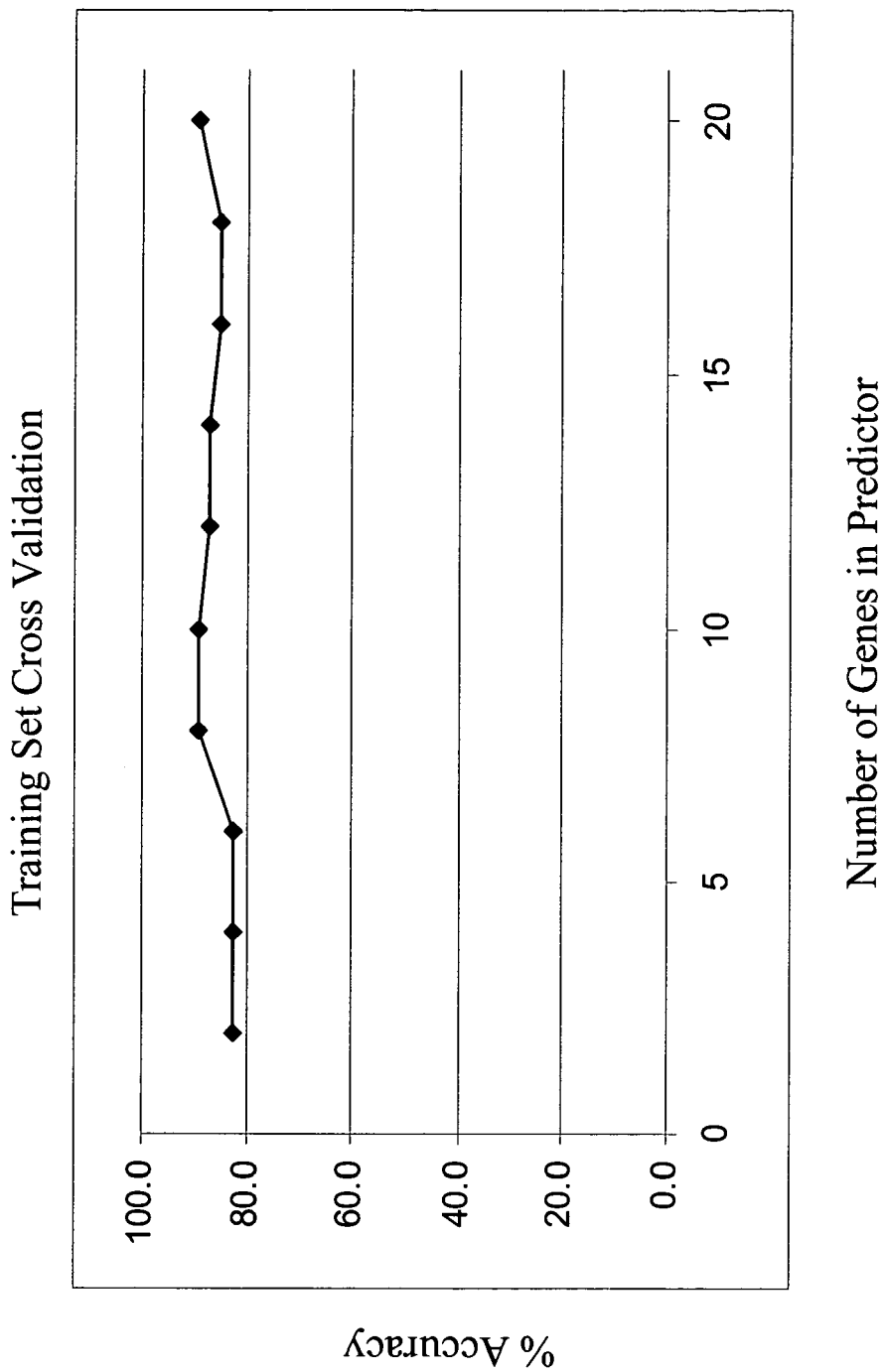
FIG. 3 is a diagram summarizing the training set cross validation results for predictor gene set of increasing size.

FIG. 3 shows a summary of the training set cross validation results for predictor gene sets of increasing size. A subset of RCC and normal PBMC samples (70%) were used as a "training set" to generate classifier gene sets, and then each predictor set was evaluated by cross validation to identify the predictor set with high accuracy for classification of the samples in the training set. Genecluster's default correlation metric (Golub et al., supra) was used to identify genes with expression levels most highly correlated with the classification vector characteristic of the training set. All of 5,249 genes meeting the initial filter criteria were screened using this approach.

Prediction was also performed in Genecluster using the weighted voting method. In this method, the expression level of each gene in the classifier set contributes to an overall vote on the classification of the sample (Slonim et al., supra). The prediction strength is a combined variable that indicates the support for one class or the other, and can vary between 0 (narrow margin of victory) and 1 (wide margin of victory) in favor of the predicted class. Predictor sets containing between 2 and 20 genes were evaluated by leave one out cross validation to identify the predictor set with the highest accuracy for classification of the samples in the training set (FIG. 3).

Figure 4:
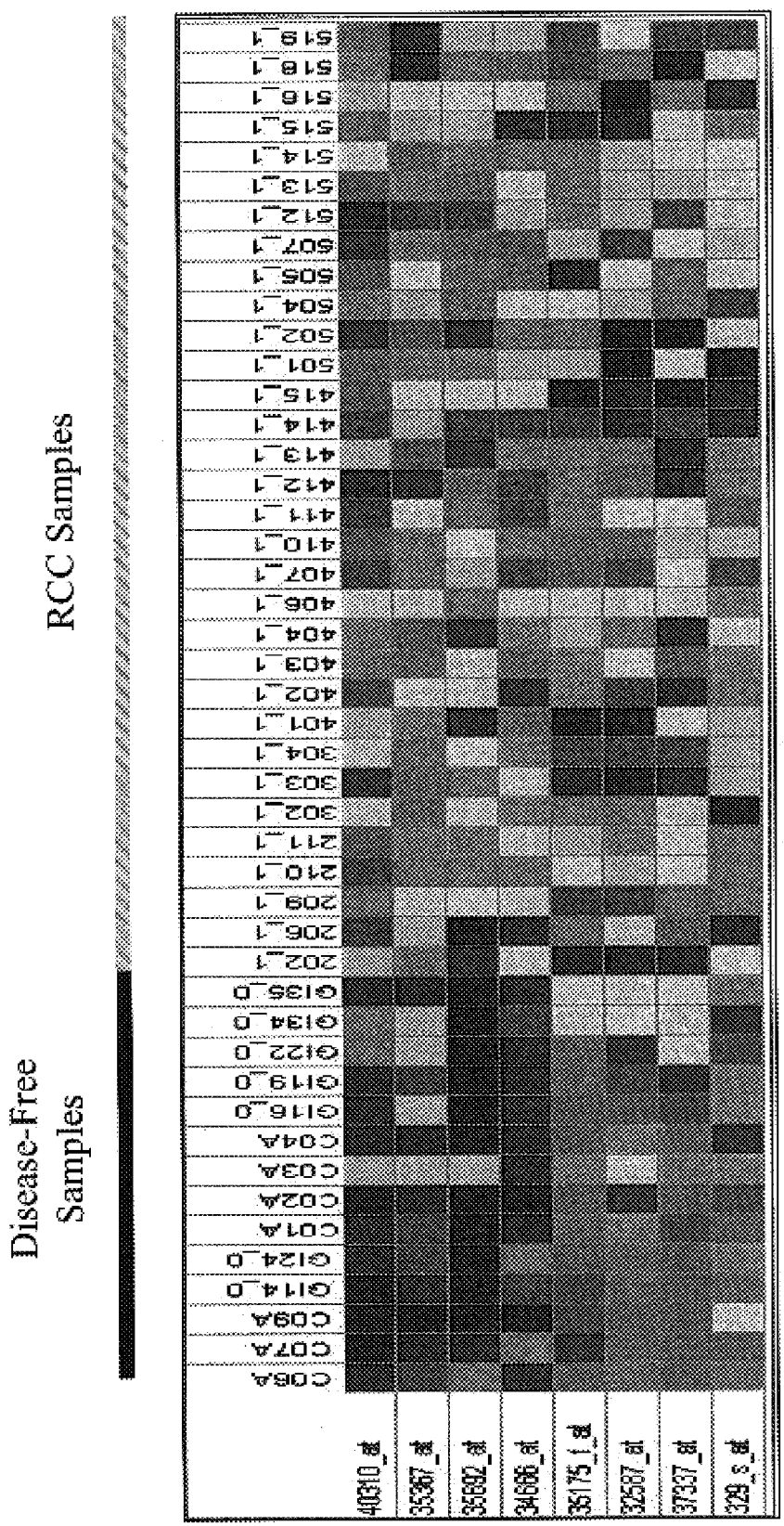
FIG. 4 illustrates the relative expression levels of a set of eight predictive genes in a training set.

The 8 gene predictor set (89% accuracy) was selected for test set prediction. The 8 gene set consists of TLR2, LGALS3, DKFZP586E1621, SOD2, EEF1A2, BRF2, SNRPG, and NUMA1. FIG. 4 shows the relative expression levels of the 8 predictive genes in the training set. Each gene is represented by its respective qualifier. Graphically presented are the 4 genes elevated in RCC relative to normal PBMCs (TLR2, LGALS3, DKFZP586E1621, and SOD-2) and the 4 repressed genes in RCC relative to normal PBMCs (EEF1A2, BRF2, SNRPG, and NUMA1). The expression level increases from blue to red.

Figure 5A:
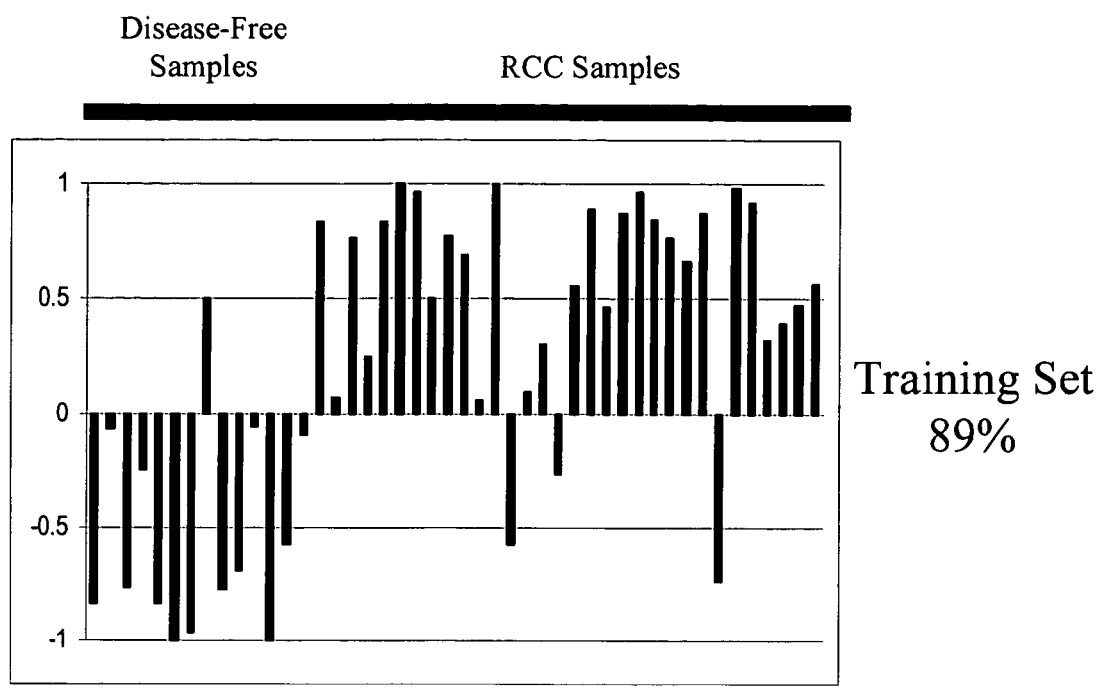
FIG. 5A demonstrates the cross validation results for each sample in the training set using the 8-gene predictor set as illustrated in FIG. 4.

The individual prediction confidence scores for each sample in the training set using this 8 gene classifier set are presented in FIG. 5A. For illustrative purposes, a positive sign was assigned to the prediction strengths resulting in votes for RCC and a negative sign was assigned to prediction strengths resulting in votes for normal PBMCs. A leave-one out cross validation was performed and the prediction strengths were calculated for each sample in the training set. Training set samples were ordered in the same order as in FIG. 4.

Figure 5B:
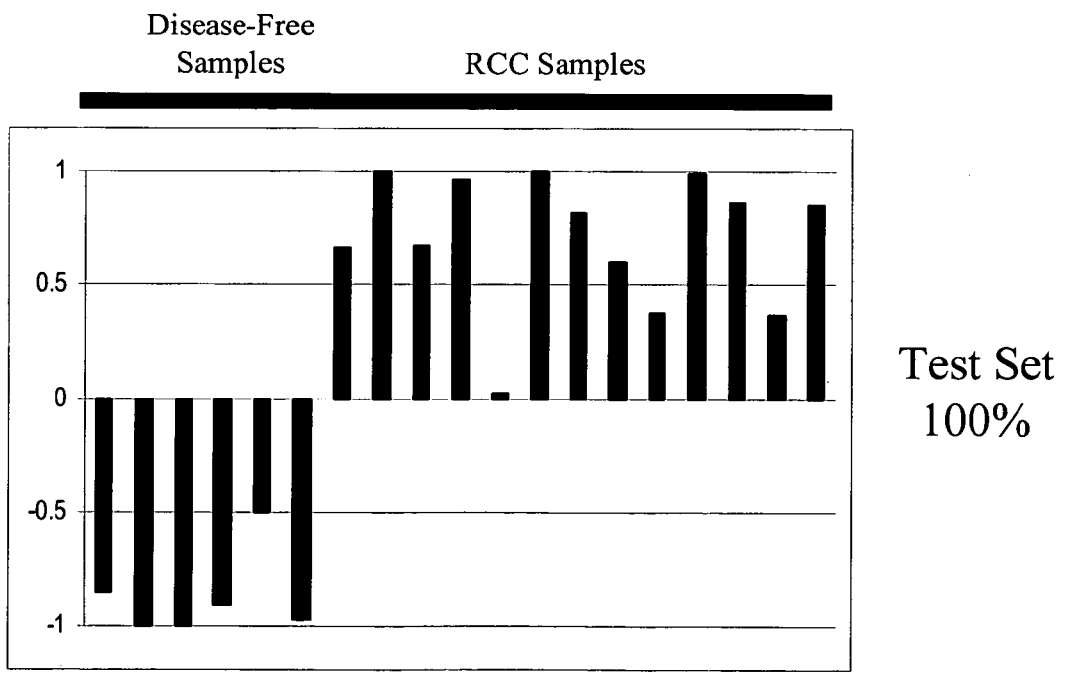
FIG. 5B shows the prediction results for the remaining test set of RCC and normal PBMC samples using the 8 gene predictor set as illustrated in FIG. 4.

FIG. 5B illustrates the prediction results for the remaining test set of RCC and normal PBMC samples using the 8 gene predictor set. On the test set, the predicted class matched the true class in all cases, though for one of the 19 test samples the prediction strength was negligible. These studies demonstrate the feasibility of predicting RCC versus disease-free status using expression patterns found in a limited number of gene transcripts in mononuclear cells from peripheral blood.

Example 7

Differentially Expressed Genes in RCC Tumor Tissues and Non-RCC End-Stage Renal Failure Patients Expression profiles of RCC PBMCs were compared with expression profiles of RCC tumor tissue or PBMCs from patients with renal failure. In each comparison, a multivariate (hierarchical clustering) analysis was employed to search for co-regulated batteries of genes between the groups, followed by a fold-change analysis and Student's t-test to support any findings. In the first analysis, expression profiles of RCC PBMCs were compared in silico with expression profiles of RCC tumor tissues (n=43 biopsies) from the GeneLogic BioExpress database (Gaithersburg, Md.). All samples were ordered in a supervised fashion (i.e., no arrays were clustered) and genes were ordered using a hierarchical clustering approach to identify gene sets upregulated in both PBMCs of RCC patients and RCC tumor biopsies compare to disease-free controls. Fold change analysis identified 24 RNA species that were statistically significant (p<0.05, Student's t-test) and greater than 2-fold induced in RCC PBMCs relative to disease-free PBMCs and in RCC tumors relative to disease-free kidney tissue.

These 24 RNA species correspond to FABP5, SCYA20, ADM, COPEB, FCGR3B, UNK_M62896, FN1, HMOX1, ITGA7, DGCR5, CBP2, UNK_AL049250, SLC1A4. MMP9, SLC16A3, LILRB3, FCGR1A, LHFPL2, PLEC1, S100A11, SPOP, CCR1, TLR$_2$ and KIAA0750, respectively. In addition, these 24 RNA species are capable of hybridizing under stringent conditions to CPSs 57, 229, 92, 91, 221, 26, 236, 207, 16, 8, 245, 152, 2, 58, 192, 19, 99, 28, 191, 138, 143, 61, 1, and 148, respectively.

In the second analysis, PBMCs from non-RCC end-stage renal failure patients (n=8 individuals) were compared with PBMCs from disease-free volunteers and patients, with RCC. Hierarchical clustering of genes in these groups of samples identified several clusters of genes that appear to be similarly regulated between advanced RCC patients and patients with end-stage renal failure. Fold damage analysis identified a plurality of RNA transcripts that were statistically significant (p<0.05, Student's t-test) and greater than 2-fold induced in RCC PBMCs and in PBMCs from non-RCC patients with renal failure relative to disease-free PBMCs. The CPSs capable of hybridizing to these RNA transcripts under stringent conditions are depicted in Table 9. The genes corresponding to the CPSs are also indicated.

TABLE 9

RCC Disease Genes that Are Differentially Expressed in Non-RCC Renal Failure Patient Relative to Disease-free PBMCs

| CPS No. | Corresponding Genes |
| --- | --- |
| 92 | ADM |
| 91 | COPEB |
| 34 | AQP9 |
| 222 | PTGS2 |
| 244 | STIP1 |
| 53 | SOD2 |
| 151 | PDXK |
| 18 | IL1RN |

TABLE 9-continued

RCC Disease Genes that Are Differentially
Expressed in Non-RCC Renal Failure
Patient Relative to Disease-free PBMCs

| CPS No. | Corresponding Genes |
|---|---|
| 21 | ANXA5 |
| 109 | IFIT4 |
| 211 | IL1B |
| 201 | GRO1 |
| 104 | PLAUR |
| 130 | NP |
| 58 | MMP9 |
| 192 | SLC16A3 |
| 19 | LILRB3 |
| 99 | FCGR1A |
| 28 | LHFPL2 |
| 191 | PLEC1 |
| 138 | S100A11 |
| 143 | SPOP |
| 61 | CCR1 |
| 1 | TLR2 |
| 148 | KIAA0750 |
| 105 | CDC34 |
| 158 | POLR2J |
| 10 | ETS2 |
| 125 | MAD |
| 52 | GPR3 |
| 11 | PIP5K1C |
| 220 | PRF1 |
| 178 | PSMA7 |
| 154 | INPP4A |
| 12 | TCFL1 |
| 47 | DGAT |
| 146 | S100P |
| 165 | DOC-1R |
| 62 | C8FW |
| 128 | PDI2 |
| 133 | GEF-2 |
| 147 | TNNT1 |
| 111 | BSG |
| 84 | IL17R |
| 227 | HK3 |
| 115 | RALBP1 |
| 195 | RNASE2 |
| 25 | TPM1 |
| 40 | BLVRB |
| 35 | APS |
| 17 | PPARD |
| 157 | NFE2 |
| 14 | IL1RAP |
| 173 | S100A12 |
| 174 | CD9 |
| 9 | ENIGMA |
| 135 | HAGH |
| 247 | NCF1 |
| 250 | FLOT1 |
| 94 | ITGA2B |
| 148 | KIAA0750 |
| 194 | FKBP8 |
| 4 | DUSP6 |
| 87 | CBFA2T3 |

The genes and CPSs listed in Table 9 can be used as markers for renal failure and other types of renal dysfunction.

Example 8

Prediction of RCC Status Versus Disease-Free Volunteers and Patients with Other Solid Tumors In this analysis, expression profiles were compared simultaneously among four classes of PBMCs which include RCC PBMCs, disease-free PBMCs, prostate cancer PBMCs, and head and neck cancer PBMCs. An initial hierarchical analysis demonstrated the global transcriptional relationship between the expanded database of PBMC expression profiles. 70% of the samples were then used as a training set, and a multi-class correlation metric was employed to identify and rank the genes most highly correlated with each class of PBMC expression profile (RCC, disease-free, prostate carcinoma, head and neck) in the database. A 20-gene classifier was determined. These genes and the corresponding CPSs are illustrated in Table 10. This 20-gene set can be used to predict each class versus all other classes.

The ability of this gene set to predict the remaining 30% of the samples as RCC versus non-RCC was calculated. The gene set was able to predict each remaining PBMC profile in the test set as RCC or non-RCC with 89% or 92% accuracy, respectively. As appreciated by one of ordinary skill in the art, a subset of these 20 genes, such as 2, 4, 6, 8, 10, 12, 14, 16 or 18 genes, can be used to predict RCC from non-RCC. Non-RCC includes other solid tumors, such as prostate cancer or head/neck cancer.

TABLE 10

Gene Set For Predicting RCC Versus
Disease-free Volunteers
and Patients with Other Solid Tumors

| CPS No. | Corresponding Genes |
|---|---|
| 268 | CD44 |
| 269 | CRADD |
| 270 | CCRL2 |
| 71 | KIAA0837 |
| 271 | KIAA0707 |
| 272 | KIAA1113 |
| 64 | EREG |
| 273 | UNK_AL050119 |
| 17 | PPARD |
| 37 | CTSL |
| 59 | ATP2B1 |
| 274 | UNK_AF052115 |
| 275 | MITF |
| 276 | STAT3 |
| 264 | KIAA0410 |
| 277 | TPD52L2 |
| 278 | UNK_AI732885 |
| 31 | MARCO |
| 69 | LOC64116 (also referred to as UNK_AL049963) |
| 50 | PDNP2 |

Example 9

Identification of a Solid Tumor-Free Predictor Gene Set

Supervised analysis of expression profiles in disease-free PBMCs and PBMCs from different solid tumors was conducted. PBMC expression profiles from 3 out of 5 Head/Neck cancer patients, 14 out of 20 disease-free volunteers, 11 out of 15 prostate cancer patients, and 32 out of 45 RCC patients were classified, and a k-nearest neighbor's algorithm calculated the genes most highly correlated with each class distinction. The 19 top genes with expression patterns most highly correlated with these PBMCs from head/neck patients, disease-free volunteers, prostate cancer patients, and RCC patients were identified. The top 19 genes thus identified were then used to determine the accuracy of prediction of solid-tumor versus solid tumor-free status in the remaining PBMC samples. A weighted voting method was used to determine the prediction strength for each sample. These 19 genes are listed in Table 11.

TABLE 11

A Solid Tumor-Free Predictor Gene Set

| CPS No. | Corresponding Genes | Entrez Accession No. |
|---|---|---|
| 258 | NUMA1 | Z11584 |
| 285 | CXCR4 | L06797 |
| 107 | IL10RA | U00672 |
| 286 | M9 | AB019392 |
| 287 | FAU | X65923 |
| 256 | BRF2 | U07802 |
| 288 | RPS6 | X67309 |
| 255 | EEF1A2 | X70940 |
| 289 | BAG5 | AB020680 |
| 259 | AKR1B1 | X15414 |
| 290 | UNK__AL022721 | AL022721 |
| 266 | C1QBP | M69039 |
| 291 | DKZP586E0820 | AL050147 |
| 292 | NONO | U02493 |
| 265 | PSMD3 | D67025 |
| 131 | UNK__N74607 | N74607 |
| 293 | UNK__AI743507 | AI743507 |
| 294 | MAPKAPK5 | AF032437 |
| 295 | UNK__U79297 | U79297 |

The foregoing description of the present invention provides illustration and description, but is not intended to be exhaustive or to limit the invention to the precise one disclosed. Modification and variations are possible consistent with the above teachings or may be acquired from practice of the invention. Thus, it is noted that the scope of the invention is defined by the claims and their equivalents.

SEQUENCE LISTING (4904 sequences)

SEQ ID NO: 1 - DNA, 2635 bp, Homo sapiens
ttctcttttaacagtgtttggtgtgtgcaagcaggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcctgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctaagttggggatctttatgtcactagttatagttaagttcattcagacataattatataaaaactacgtggatgtaccgtcatttgagga

SEQ ID NO: 2 - DNA, 545 bp, Homo sapiens
ttttttttttttttttttttgaaggaggctgaacactggggagctttaatggcctgttacagggtggcagaaacagtggctgggtctgggagtcacagcaaaatcaggcgcccagaaccatggtggaaggtggggttgctagttcatgaaaacttgaaggacattaggaagaggcggcatttgatgctgtcaagtaactacacacagaacaagggcatgataaaagtcctaatgcacatagagaacaaagccctgctcagaaatgctgtcctcaccagcagaaaggactctgtggagaaagctgtcccttacataaaaaagaagaacatactgggttagcacttgatatccaagaagtgaaatggtcgttttcgaagattaacagtttgcttcaccaaatccctctgaggtaggtaagaggcaggtgacattagccccattttacaaatggggtaaagtgaggccccaggacctgttacatcacgaatatgcatcaacagccacaaacagcacgctctcagatcttccccttcacttagcttaga

SEQ ID NO: 3 - DNA, 943 bp, Homo sapiens
gcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtg

SEQ ID NO: 4 - DNA, 2390 bp, Homo sapiens
ccagcctcggagggagggattagaagccgctagactttttttcctcccctctcagtagcacggagtccgaattaattggatttcattcactggggaggaacaaaaactatctgggcagcttcattgagagagattcattgacactaagagccagcgctgcagctggtgcagagagaacctccggctttgacttctgtctcgtctgccccaaggccgctagcctcggcttgggaaggcgaggcggaattaaaccccgctccgagagcgcacgttcgcgcgcggtgcgtcggccattgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaagtgaagactaattcaattttgcatatagaggagccaaagagagatttcagctctgtatttgtggtatcagtgttggaaaagagaaatctgatactccatttggattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctctgttgtaatccaaaggggagatttgcagcatgcttgactttaccaattctgatgacatctttacggacactattatcactaagaccttgttatggcgaagtctttagtctttttcatgtattttcctcatgattttttctctttatgtagtttgagtatgccttacctttgtaaatatttttgcttgtgttgtcgcaaaggggataatctgggaaagacaccaaatcatgggctcactttaaaa

SEQ ID NO: 5 - DNA, 191 bp, Homo sapiens
  misc_feature (135)..(158): The "n" residues at positions 135 and 158 are t and c, respectively, in accordance with the correpsonding sequence (KHSRP gene) in the Entrez Human Genome Sequence Database.
  misc_feature (135)..(158): The "n" residues at positions 135 and 158 are t and c, respectively, in accordance with the corresponding sequence (KHSRP gene) in the Entrez Human Genome Sequence Database.
tgcgggtgctgtctgtctccccccctttccttccctccctgtagttttgaagcggatgtttgttctttatagatgttgtttaaaaagcctgataatggtgattgaaatttacaaactttgtgttttttttttttnaagaaaaatataaaatagttttnttcaggctcaatgtgctttcctaaccgtgcccc

SEQ ID NO: 6 - DNA, 1716 bp, Homo sapiens
gatctgaacccaaactaaatttcccagcaagcagcgcgccggcctgggaaaaggagcaagatggctgactccaaagagggtgttttgccgctgacgctgcttccactgccccaatttcattcggcttcactcgcacgtccgcacggaggcgctggccgactcgagagacggcgcggggccatctccggaggaaaaggatttcttgaaaaccgtggaagggagggagctgcagagtgtgaagccccaggaggcccccaaggaactcgtcatccctttgatccagaattggccatcgcaggcagccaccagcccggccccctgcaggtccacagatactggggccttgcggatggggtggtgtcccaggctgtgaaggagctcattgcggaatccaagaagtctctggaagaaggaaagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggtggccatgctgcggggcatgggctggaaacctagcgaggcatcggccgcaccttcaatcaagtagtgaagccccgtgtcaactcactgaggccaaggggttagggctggggtgccaacctgaccgagcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtgtggagccgggtggtgactgttagtgagtactactgcggcctgtctcccagcaggagtttgacaagaacaccttggatctcaggcaacagaacggaactgcctcatgcacggaagaccctctggaatcaagaactctacatccagcaggacaactcagagaggaagcggaaacaccttccagaccgacaggatggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggtgacccgggatttggtgcaactgccaagagaaaatcaggtggtggtgacttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttaagggtataataaaaaccatttcaagtacttaataaaaaaaa

SEQ ID NO: 7 - DNA, 1238 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaaaaaaaaaaaaaaccatggtacccggatcctcgaattc

SEQ ID NO: 8 - DNA, 1284 bp, Homo sapiens
cagcgggtcggggaccgaaagtcgcttcggggcgggcgccagtctccggcccagccccgggccggcatccaggcgccgccgctccggcccagccccggcccggcccctatgatgaagagggcgtccactggagttcttgctgtcgacatctttgacaagttcaacttcacgggagccagagtcccatggttcgacgccattcatgaagcattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcataccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggaccacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcaggctccgcgtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttgg

SEQ ID NO: 9 - DNA, 1725 bp, Homo sapiens
gaattcccgttgctgtcgcccaacgaggctccctggagccgacgcagagcagcgccctggccgggccaagcaggagccggcatcatggattccttcaaagtagtgctggaggggccagcaccttgggggttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcgtacacctttgcacccagcgtctccctcaacaagacggcccaaccctttgggcccccccgcccctgacagccccccgcagcagaatggacagccgctccgaccgctggtcccagatgccagcaagcagcggctgatggagaacacagaggactggcggccgcggccgggacaggccagtcgcgttccttccgcatccttgcccacctcacaggcaccgagttcatgcaagaccccggatgaggagcacctgaagaaatcaagccaggtgccagacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccacacagccagccagccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctgggctccctggccctgccccacccaccttatcctcccaccccactccctccaccaccacagcacaccggtgctggccacaccagccccctttcacctccagtgccacaataaacctgtacccagctgaaaaaaaaaaaaaaaaaaaaactcgag

SEQ ID NO: 10 - DNA, 101569 bp, Homo sapiens
  misc_feature (22955)..(22955): No residue exists at "n" position (position 22955) in the corresponding human genome sequence (ETS2 gene) in the Entrez Human Genome Sequence Database.
aagcttggtcgaaagccttctatggcctcagtctatcactcaagcagaaaccaccaacacccacatgctttcctgtctgcgttggcagaacttcactattaagttgccctctctaatatgactttactattctaagaaatcgttgcccaggaaataaaagttactaattgtattgtttcaggaacttcccagaaaaactaatttaagtgattatcaaactactcaactcttcaataactagtatcaaggattatttactctccaatacacttctgagaaccctgccttaaaaccctcaccttgctgtcttcaccaatcctgaaccattatatcatgatccttaatcctattcaaacttctttccccattgaaagacctgccaaaccccctaaaccttacaaatagcccaactttgtcatactcacagaaaatactatgcagactttgttgagatagttgtgttgcttaccatgggaagcagtaaactcagctttgcctgaccagcaggttgttggggtgatgtttttggggagtcagtactggacacctaagtaaacttgttacttcatgcttccctcttctagaaggcagaataatggctgtccaaagatgtccacatcttaatcttaggaacctgtaaatatatttccttacatagcaagggggaattaaggtagcagatagatttaatgttgctaatcggctgactttgaaatgatgagatcattgatacagcttgaatatatgtccctgtcaaatctcatgttgaattgtaatccccagtgttggaaatggggcctggtgggaggtgattgggtcatgggggcggatccttcatggcttggtgctgttgtgataatgagtgaattctcaggagatctggtatttaagtgtgtggcaccttccccctacttgctctctcttgccctcattctcaccatatgagatgcctgctccatcttcttccaccctgattggaagcttcctgaggcctccccagaagccaaccagatacagtcactatgcttcctacatagcctgcagaaccgtgagccaaataaacctcttttctttataaattacccaggcttaggtatttctttagagcaatgcaagaatggcctaatacaattatcctagattctccaggtgggaacccatgtaaacacaaggatctttacatgtggaagggggaaactgaaagagtcagtgtcaaatcgatgagatgcaggaaagactcaaccaaccgttgctggcattgaagatggaggatggggccacaagccaaggaatgggcagccttagaagctgaaaaaggcaagaaatgcatttctacctggagcctccagaaaggaatgcaaccctgccaacacctagattttagcctggcaagatctgtattagacctctgacctccagaactgtaagataatcttgtgttgttttaaccagcaaatgtctgttcatttgttttggcagcagtagaaaaccagcatatctctccttgctgatgctcctttctccatctgaaatctcaatctgatctcactcttctgcctgttgaaatcctgcctaccctttcatttcaatggcagatccacctcctccaagatacacttccctgaacaccccttttctgaattctatcagcatctggtttgttctccttcattatttattatttttatttttttcagatggagttttgctcttgttgcccaggctggagtgcaatggtgcgatatcggctcactgcaatgtctgcctcccaggttcaagcgattctcctgcctcagcctctcgagtagctgggattacaggcatgcactaccatgcccggctaattttgtatttttttagtagagacagggtttctccattttggtcaggatagactcaagctcctgaccccaggtgatctgcccaccttggcctcccaaagtgctgggattataggcgtgagccaccatgcccagcctgttctcctttattttatacgatcacatttactagggtatgtagcgtatatcttctatgtcttataaataacttttgcacagctgaatggtaaagatttgtctattctttcaatgtaaccataccattatccctttagctagctaaataacatccatggtgggtacagaagtatcctgacagaagtcatgtatttgaggaatgaaatgtaagttcttcattaattaaggctgggagaatcttcctcttttggaaactaatatatcaacttgaaagtcaattctaataagaaggttgaaagaatgatatggaaaggaatttgtgaataatagaaaagaaatgaaaagaacactttctgtaaggctagcttctccactgggcatcagggctgttgctttgagcctatagcttttctagcgcctatgaaaatatttgaaagcctagacaagaaagaaacatcaggaagttaaaataggttcatcaaatgtctacaaaatgtaaccttatctcaactcattaactgaattttgcatacatacaaattccattacatttgcaaaaaatgtgtaagtttgtttttctcacttcatcagaattcagaattctcaagcatgcaccaggaacgaaaataactacttttcgccaactaattttgaaagcaatgttttctcttaattgtttcaaattactttacatttgaaaatatttaagatgagaagtagatgcattttaacatatgtgatggaatgtatcatggagcctccaaaattgagagaccctacagcctacccagagcttaaagcagccccgttagttactgggcagaaaggaatggggtgtggctgacaggtaatgtggatgatggtggtaataacagtgactcatattccttgcacacttaccatgtgtcctttatttcttacatcattttttaaaaattgagggctgggcgtggtggctcactcctgtaatcccaggcctttgggaggccgaggcgggcagatcatgaagtcaggagatcaaggccaccctggctaacacagtgaaaccccgtctctactaaaaatacaaaaaattagccgggtgtgatggcaggcgcctgtagtcccagctacttgggaggctaaggcaggagaatcgtttgaacctagggggcagaggttgcagtgagtcaagatcacacccctgcactccagcctgggcaacagagcaagactccatctcaaaaaaaaaaaaaaatttgaggtaaaactcacgtaacatacaagtaagtattttaaatgcacaatttagtgcattcacagtgttgggcagctaccacctatctctagtttccagtctttttcatcaccccagaaaaattccccataactgtcaaacaagaactctccactccttcctcccttcagcccctggaaaccaccaatctgctttctgtttctatagatgtgcctattctggacatttcatataaacagaatcatacaagtgactttctgtttctgacttctttcactttgcatgttttcaaggttcatccatgtcgtaacatatgtcagttcttccctcattttttggctgaataatattttgttgtgtgtattttgggctactatgaataattctgctgtgaacatttgtatacatgtttctgtatgggcttttttttttttttttttttttttgaaacagggtctcactctgtcacccaggctctggagtgcagtggtgcaatcatggctcactgcagccttgaactcctgggctcaagtgatcctcccaccttggcctcccaagctgctgggactacaggcatgtgccaccatacccagctaatttttgtattttttgtagagacaaggttttgccacgttgtccaggctggttttaaacccctgagccaagagatccacctgcctcagcttcccaaagagctgggattacagcctcgagccactactcccagccacattttgatttctcttaagtatacacactgggagtgagactgctggatcatatgataagtctgtgcttaactttttgaggaatgattcctttcatcttttcaacagcaatatgggaattggaaatcagtgtgatcatgtgcccaaggtgacactcccataagaggtggagtggaatttacagtcaagccattctgattcagagcccctgtccttgcactcagtcaagatgtctcgttagtgtacatgaaatagagacagtggtgggagctgagggctgcacgcagggcacaacaagaggtagaggctagcaagcgtaggatgtgctcaggtgcattcagaatcgaggactatgagggtggacaggggccagattcttgagaatcctgaaggacagcagagtaggaagccatggctccaaagtcaggcagccagaagtagatgggctttgaggaccaatggtgccagggtgtgtcattgggaccttctaggaactcaggtaaaaaatgatggccaagagtaggcaatgttagagagttcatcctcaggcacagacagggcaaagtgtgcagcaccgtggactgcctttgtgacttttatgattagattgagagaatcaccacctcttagcagagagagcaacaaacaatgcaaacaatgcaaacacagacacacaaagaaggagaaacaatagccctcatcaccacagccctagtggtggcagcaactaaggaaattatatagagaagttggaggagcctgtgcaaccagcaaacagaaatgttgtgaacccattgagatgtatggactttccctgacatgctaccaaaagtttgtcattttaggagccctgaagacttcttgaagatctgatgtgcaggcctagatctcaagcttatttatttttctgttcttcttcttgcatattaagatggatgcttttcttattaattttcagccttgccctttttccccaatatgtataaacaatttcaagctataaatgtgcttctaagttctgctttagctgcacgtcctctttctttctttctttcttttttttttttttttgtgagatggaggcaggagtgcagtggcgtgatcttggctcactgcaacctctgcctcccaggttcatgccattctcctgcctcagcctcccaagtagctgggactacaggtgcccgccaccacacctggctaattttttgtattttttagtagagatgggtttcaccatgttagccaggatggtctcgatctcctgacctcatgatccacccacctcggcctcccaaagtgctgggattacaggcgtgagccaccgtgctcagcctcctttttcatatttagtattttcctaatcattcagttgtaaatattttaatgtccattatgatttcttcttccaccttttgttttgattatctattgctgcattccaaaaaaaaaaaattagcttaaaatgacaatcatttcattctatctcatgatattgtgggtcatgaattgggacaggtttcagctggatgattctcctgctcttctgaacattaactaagggaactagtgatcttcagctggtagatgggctggtctggagggtccaaggactttcactcacatgttggcatctgggtgcagatggctggatggcatgctcagtgagactgctggacagtggctacctctggcctctgcagcttggcaggctcaggatggttggaccaactcaaagcagctcagatccccagagagagaggaactggccagtctgggaattgaatctagaaattagcaaagcacaattccaccatagtctgttgcttgaagcaacacagaaaggtctcccagatcattggaaggcacacagctcctgctgctgaatgggaatagtggaaaaatatttctgatcattctttttggagtgaattgtgtcccccaaaaattcatatgttgaaatcccccagaacctcataacatgactttttgcaggtagggcctttatagaggtaattaaattaaaatggggtggttagggtgagctttagtccagcatgactggattagaagaggagattctgacacagacacacaggcacaaagcccatgtgaggacagtgagaaggcagccatctgcaagccagagggaggcctcgcaaggaatcaagcctgtcgtcacctcaatcttagacctcttgcctctagaactgtgagaaaataagtctaatgtttaagtcacccagtctgtggcgttagttatggcagccctagcaaactaatacattatctttaatccatacattaatgaattcttcataattacctttctttttctttttctttttcgagatggagtctcactctgtcgtccaggttggagtacagcggcgcgatctcggctcactacaatctctgcctcctgggttcaaatgattctcctgcctcagcctcctgaggagctaggattacaggtgtgcaccaccacgcctggctaatttttgtatttttagtagagacaaagtttccccatgttggtcaggctggtctcgaactcctgacctcatgatcagtccacctcggcctcccaaagtgttgggattaaaagcataagccaccacgcctggcccataattatctttgttaaacttcaatcacatgggtttctaatttaatagcatggcgactacagaatgtggtctgtcatgtatcaagcatttgaaattggttgagccttccgttttagcctttatgtatgtgtaagatattggaaaatattcttggtaaaattgaccagaagatgtattctacagtcactgtttaagaaacaagtgaaaatggtggttaaaataaccaaaacaactaaacgtgtgtggaaataaacaaagactacccaaaggagagcaggcagaggcgatccattcagagcttgctgtagcataggagtcagacactgtcacttgtgtttggcagaaactcaaatcaggctgttgatcaagtttttatcatgagggcaggtttcaagactgccattcatttttcactgatagtttactttgggcttaccaggaaaatcagtcactgttaaccaatcattggtttctatgtaaatcaaaatattaacaattgcccaagtgcagtagctcacaccttcaaccccagcactttgggagcctgaggcaaacaaattgcttgagcccgggagttcaagagcagcctgggcaacatggcaaaccccacctctaaaaaaatacaaaaattagcctggcatagtggcatgcacctgtagtcccagcttctcgggaggttgaggtaagaggatggcttgagcctgggaggtcaaggctgtagtgagccatgttcatacgactgaactccagcctgggtggcaaagggagaccctgtcttaaaacaaacaacaacaaaaaacagtctctatttacataacttaaagaagccctttggagaaggtagaaacagactttgctgccctctctgagcaaacattgtctcattaatcctccccacaacccaacaaggaggtttgacctactgagttccattttaggagataagaagccgctgtatgcctcagttggctacccagtctaggggcagtaagcccccacttgctataataggttgtgattgtctgatgtattaaactgaactttaaaaagtcatttctatttcgctacacagcagtggggcagcgcagaaacaaggaaattatatcttccgcttcgactgtttttcatttttactttgtgtttctagattctcaaacttccatcactctaacagattctcaaattagaggagaaaacaatcttactttacataaaaacaccaaattgatcctttatggatgcagtgtggtcaatgacagcatttgttttcccagcatagattgtgctgatgcattgtgtatgtggcctggtctgtagcctgtgtgattgacagatgattgagagacagagagagagagagattgtcaggaggcttaatgatcctcacaacacaactggggtaggtgctgtggcccccacattacagccgaggcccagagagagtcagtagctcacccaaggtcacacagcttgtgaacagcagagccataatttgatcaatgctgctaggctgcctgtcaaaatacacccaaaacaaaacttactttttgtatagcatgagcttttaattctacgggttgctgttgcattgaattatgccctagtgtaacacaaactaaaatatccagttgcaaaattaaataataaataaataatgggtctgcgtgctgtttatcagtccaaatgtggctgcattttttggccaactatgtcttttaagattacatcctaacattaagtttttgttggtttctaatcccagctttggcagttttggacaaaagctatgggcataatatcctcttggccctccaggcaggggcgctgcagattctgggctgggggtcagtgggggcagcttacaaaatgtttttctgtgagggcctcagctgaaatagaggggaacactgctgagctctggcctctgtgtctgtatcttgactgactttttaaatttttttttctgaaatttctgtgtggcctgacaagtccgagactaccacaaagtggccacaaaatttgtttaaatgttgtctgtcaagttggaaattttattttaaaattcatggtgcaatggcattataataaaccttatttttccttctgcagtctgtttctggatgctggcagtcattcagaaacatttgctgagcacctcgtacctgctgaatgaacccacgtgaaggggagccaggagtgcggatcattaaaaagcctgtactttctcagtccccatttgacaccacagagagaaaatgcatgctcctgatttgggtagatctagaatgttcttatgaatatggtaggtggagcaagggaaccaggttcttatgatacatgataagaaaggccctagcttggtcagacacaaataaaagccaagcttttcatctaaactcccttgcaccatcacccccttaccaaccagtacagagagcttaacatctctataccagatagtgaatgtttctaataagaatggcaaattcttattgtgagagagataagggcattcaagtgttaattcaagagaaatatgtatatggttctttaaatgatttatttactaacagcattaagtatggtgtaaaggaatttacataccctaattctcgtctatatatttttttggattttaaaatgacaacttgtctaagttcgcattagtattaagccctaacatgagacagtatttatagcataagatttttgccacctatttttaattgtagcgctgttttatcaataagatcaattaaagagttgaacttttgaaaagaagaaacatgaaaatgaatttctaactgtacagtattgaatacatgaaagttctcttaaacttagtccagagtctcaataaacatggtaagtatgtaataattcacatttacaaccgccataaaaactctatcaaccaaattattttatgacgtcaaaattatctgaaaaaaattgaggaactaaaatttttaaaaataggttctcagttagagctgtctattaaaaggataaattttaaactctccggagctggccttcctggttccaggagcagcctgttggccttctctcgcaaagctcagttcctttcctccattccagaagaccctcaagcctgtcccatgcacctggttttacatttttaaatgttaaaaggaagaccaccgtgaaagattggcatgttaatagtaggctaaggcgacaggtgctggggctccagcttagagatccccacagattccatgctcccagggctggctgcagccatctgcccccacccacccccacccacccccacccggcccagccctcccctcctggaggtggaatcgtggcttgcacaatcccctctgggcccctgggggaggcgcaccatattgattttttggacttcgtttctgtgtgtctcaccagtctttgcccggcacagtgactcactggcgtccctttcaggactttctcccgcctgataacatctaaatgactcatgcctacaccacctggagagctcagggaaggcacggtttgttcaggccaccctcactccaagggccagcccttttttggaatagaaactaaaagttggtagcttccatttgtagttccatctaacagaagagccgacccactcacattagctggctcacgactaaggcaaccaatgcctcccagaacatagactcaactggcaaccccggcactgaaggtcaaggtgagtcaaagacactcatgcagaagggtggatgctcttccaagtgtgactggctggcctgcacggctcactgcctcccctcctcccgtcaagatgcagcttcagtttaaaccaccttcgttccattcatcaaagaggaatatttactgttattgtaatgactcttctcacagtacacaaggctacacctgaaacacacaggcctttcagaaagcacaaaggagcattgtgcaagcccctgcccagtgagatggatgggggcgtagacacgccagttaacagccgggctttgcaggccagcaagacttatctgtggccgcaccatggccactgagcttgtacctttcttcttttaaaaattgctccttcattataagcagagttaaatacctgcacatgtgatttgtgttgaaataataaagcaacaaacacacatcaagctgaggagagaatcttggctaaggtaggaagtcgtgggtctggtctcagtctgtgctgctgaccaactgtaagaactcagaactcactgtccactcaggaccacagtgtctcatctgaaaggacgaggagactggaacacaccagagccatggttctcaatgtgtggtccagaggccctcgggggtccctgagcctctttctggggatctgtgaggtcaaaactactttcacaagtatggtttgcctttttcactctcactctctcatgcttgaacaatggaatcttctaaaggcttcctgacacgtgatgctacaatggatggaatccagaggtggataggagaagccagctgccttctattaaaccagaaatgaagaacatttgcagaaatgtacaacaatgccatgcttcccattaattattttgttcttgctttagaatatgtcacttttcattgaaaaatgttactcatgattttatgtaaaaggtttattgttgttacttttaaatatatattttaagtgttttttagttttgatttctaatatggcaaaaattggtaaaatcacatacacaagggcttttggggatcctcaaaactttttaagagtgtaaagggatccagagaccaaaagtttgataaccactaaccaaaaactttgacaaccatcatcttgaagggtccttggactttctggaatttggatctcccttgccttgttcagttttctctctttttagccatctcgtacttacagccatttcagttcctatgtacctgacttattaattatgcttattgtttaccatgtgtgttcccctcccatataaactccatgaggactgagatatttgtccatgatgttcatcagtgcatcccaggctgcctagaactgggcctggcccttagcaggcacttgtttttggatgggagggaggagaagggaggggagagggcaagttctttcagtgtctgtataatggacagagcaaggtgtaccacctcggtgtgatagaagagatggagacaggagaaaggaagctctgcacaggatcacgtggtaggtggcaaagtcagggctccatcacagcttctgttgtcacatgactctgttatctgaccctttaaggcagccccttctgctccaacagagcttcagggtaactgagtgccccgcaattggtgttagcagagaatctgtgtccagttgatccctaaaagtttgaggaacactcattccccagtgcataagttcctgataaatgacctcataaataaatgacctccctttgtaggaggttggctggaaggctcagatgcacatggctgctggaagtgaggtcctcccacaagagaaccaacacgtccttcaagggtctcggggtctgtgaacagacatggacatcaggattggttgaggggcttccaggttcaatcctggtggcacaggtgaggcccattcaccagaccagagtgtcgccagccatccatagcaggtgtgctctttgtggctgcctatggcttttagtcctgaaaagctcaggtttaagtagccaggagcacaacccaggccttgctgctgcttctggacatctctgggagtgaaaagggagttctatgctcagccacctgagtttgtggagctcgtttcaatctcagcctctcccatcagcctcctggtgactcctctaagaggtctcagtgcttccttcaccctcaatactcaaggccttggcgaaagggaattcttctgagacctgaagtgtagaatcacgagggagaaacagtcaagcaaaattgaccgttatcgcccaggagataagacccaggagtcagttcagagaacgcagacatgaccgtagaattgtgtacatagcaggccttgccctcagtggatatccaataaattgcaatggacatatgttttcttttctgcacactctcttgcctttcccttggctggatcttggggcttctgggagagtgatgcagaggggaatattggaagaagaggctgagagcacagatgaaagtcatcccatctgtttggatttcattttaagagcagtgcagaggcattgagtgtttttaggcagagaataacattaaggaacgtacaggtgtacttcggagatattgcaggctcagttccacactgcagcaataaagcaattatcgcaataaagtcatataaatatttcaggtttctcggttcatataaaagttatattcacactatattgtagtctatctagtgtgcaatagcattatgtctaaaaaacaatgtacataccttaatttaaaaatactttattgctagaaagtgctaataatcatctaagtctttgtcaagtcataatcttcttgttggtgggtggtctttctggatgtggatggctgctgaccaatcagggtggctgtggcaatttcttgaactgagacaacagtgaagtttgctgcattcattggcttttcccttcatgaaagatttctctagcatgcaatactgtttgatggcattttacctacagaacgtctttcaaaattggagtcaatcttctcaaactctgccactgctttatcaactatttatgcaatattctaaatcctttgttgtcgtttcaacaaagttcagagcatcttcagcaggagtagattccatctcaagaaaccactctctttgcttattcataataaacaactccttgtgtgtgaaagttttatcatgagattgcagcaattcagtcacgtcttccggctccacttctaattctagttttgttgcttttttttttttaccacatctgcagttatttcctccactgaagtcttgagcctctcaaagtcatccctgagggttagaatccacttcttccaaactcctgttattgttgatattttcacttcctaccatgaatcatgaatgttcttaacgacatctagaatgagaatcttttccagaaagttttcaatttactttgcccagttccatcagaggaactactctctacggcagctatagccttataaaatgtatttcctaaataagacttgaaagtcaaaattatcccctctatctgtggactgcagaatggatgttatattagcatacatgaaaacagcatttatctccttgtaaatctccatcagagctcttgggtaactaagtgcattgttaatattgaacgataatattttgaaaggaatagttttttctaagcagtagttttcaacagggggtttaagatatttagtaaaccatactataaacagatgtgctgtcagcgaggccttgttccatttctagagaacaggcagaatggatttagcataattcttaagggcccttaagattttcaaaatggtcagtgagcattggcttcaacttagttaccagcagcaccagccccaccaagagagtaagcctgtcctttaaatttttgaagtcagacattgacttctcctctctagctatgaaaatcttaggtagtatcttctaatacaaggttgtttcatctacactgaaaatctgtgatttagtgtagtcaccttcatcaatgatcttagctagatcttcaggataacttgccgcagcttctccatcagcatttgctgcttcaccctgcacttttacattctggagatgacttctttttttaaatgtcatgaaccaatctctgcttatgcagcttcctcatacctctcaggcatcacagaattgaagagagttagggccttgctctggattaggctctggcttaagggaatgttgtggctggtttggtgttctatccagaccactcaaactctccgcgtcagcataaggctgtttcactttcttaccattcatgtgtttgctggagtagcatttttaatttacttgaagaactttctctttgcatccacaacttggctatttggcacaagaggcctggcttttggcctatcttggttttgacatgtcttcctcactcagcttaatcatttctagttttttatttaaagtgggatacgtgtgaccctttctttcacttgaacacttggaggccactgcaggcttattaactggcctaatttcaatattgttgtgcctcaaggaataaggaggtccaaggagagggagagagacagggaaatgcccagccagtggagcagtcagaatacatacacatttattgattccgttcactgttttctgtgggtacagtttgtggttccccaaaacgattataataataatatcaaggaccactgaccacagaccaccacaacagatagaataataataaatttgtgcaaataaataataaaaaaacattgtgaaaattaccaaaatgggacacagagataggaagtgagcccatgcctttggagacatggcaccagtggacctgctgtataccacaaccttcagtttataaagaacatggtatctgtaaagtacgataaggtaaagcacagtaaaacgaggtgtgccagtgttggggagcacatctggctgcctggcatagtattgactgaaagaaagataacagagggagggtatctgaaaagtaactgccagatgctatggtgtctgctcctttgcagtcagggagaagagaaagaagagactgattatcaaagaaatcccaaagctagaatccgcagacccccattccagattcattaaaagtggacaagagataggggagcctgaggattgtccctggttgactggaaggtcacccaggaggaaggggtgtacctcagagatggacagggatgggccttctgctcgtcctacaggcacccattctcagcacaggctcatccagccaaagactaaatttcccagcctcctttgcaactagatgatatcacgtgacaaaatccagaccaatgggcctgccatgtgcaattctgattagtgcccttaggaagatgagcctctgcttctctttcctcctttcctagggaggaatgcaaatgtggtagggagacatcttcaaccaggagaatgaggacacagcaaggtgggaggatcctaagtcccaaaactaccacaacatcaccaagccaacaaaccagcctagggtcaccttccccaagtgttatgggagtgaataataaacctctatttcttttttttttttttccttcgagacagggtcttgctctgtaacccaggctggagtgcagtggcacaatcttggctcactgcaacatccacctcccagcttcaagtaattctcatgcctcagcctcccaagttgctgggattataggtgcccgccaccacatcttgctaaattttgtaattttagtagagccagggttttgccaggttgcccaggctggtctcaaactcctgacctcaagtaatgcatctgccctggcttcccaaagtgctgggattacacaggagtgagccactgcacctggccaaacctctatttcatttaagcccctgtatgtgtggcctcctgttactgatgttattttcatgtgttattctacgcgaggggcagaacaacttgcttttgttgtatttcaagtgactgtatcgctgaaccaaccactctcggagccacacttcctctgcctacaggctctgtgttgacttgtggcatgaagaacacctgtgaggtatccacagcatacaccagcccagggacggaggccacatgggcctgagcctgcagctggcagtggcggacacagatgctccagcaggagtgaggggaaacactccaccaaatgaaggcctcagggtcattcggacctcgtggaaacaagttgtatcaggtttgctggcgaagcagctaggaggctgtggcagctgttatttattcttcagtaggacatttggcgcaatgtcttacatcttcatgggtaattagacaaaaagagctcaccacccctaggtgatgtcaatgcagagggagagtcctagtgacatactacgggcttggcctcagtcactgtttgttcaatgacttgcttatcagggttatatgtgggccaaagcagttactaatagaagagaccttggataacaaactcgagggtcataaagatctggagaggctggaatgatgcactgaacctacacagactcattcattcctcccccatctgttcattcagtgaaagcatattcatcaacacccagaggacgccaggcactcaggaaggtgctgggacaccacaggtgaaaagggtccggttctcactgaccctgcgctttcgtatgtggagaaagacaatgaaatacaacagaccgaggcaggtggatcacctgaggtcaggagttcaagaccagcctggccaacaacgcaaaaccccgtctctactaaaaatacaaaaattagctgggcatggtggcacgtgcctgtaatcctagctacttgggaggctgaggcaggagaatcgcttgaacctgggaggcggaggttgcagtgagccgagattatactactgccctccaacctggggaggagagaaagactgtctcaaaaaaacaaaaacaaaaacaaaagacaaaaaaaaaacagataaagcaacaaaatcatttttggagagataatgctgggagcgcattattggcaggatgtgatagtgacatgaaagtaaggctctttccgcttgggatcggcaagaactgccctgagccagtgacatttgcccatttgcctcagatgatgaaaaggagccaggcttgagagccaggtggaaagaacgccagggagcagcgagtgcaaaggccccagggggcagcaacgggagttttccaggaacagacccaggcaggtacactggagtgtgaccagcaaagaggagaatgaggaagggggtggggaccaggtcacagagggcatggtgaggagttttggattctcttctctgcagggtgagaaaccttctgggaattttgaggagagaggtggcgtcataggattaacttctccaaaggctacattggctgctgtgtgcagggtggattctaggaggtagaacagaggagagctgggaggctcttgcatggtggtgatgaccagggcactagagaagagactgtgcttgagatgtgttctggaagcagagtccacggcatttgctgatggtttatgggagtaaaggaagaagagaaatccaggacaactccaggtcttttgctgagcaaccggtgggtggtggtaccggttcctgggacgagaagcccttttctccatctctgctaataactcgctggcctgagccagcctcgtcacttgcctttaatgctcctgtggtcacatggctggctgccctgctgccaccacgcctcttccccatggtctgggattgatcatgtgcagggcagcacctgaggtccacattaacactcccacacaccaacagatgagcttggaaggaagcccctgtgtggttcacacacaggaaataggcgggtggtcactgtgtgggactgtcttggatggcaggtcaatggcacatctctggtcgaggaggggaataaggacaccaggcaggggagatgcctgagttgaaggagtgagaccaaggcagaagcccacccagaggatgagggctgagggaaagagaaggttctcatgcacagtgaacaggaagcagggggctctccggacccggaagtgaccctgggccggccaggggacagaccagtctctactataccatggggctggctctgggggtattttaggtctccaggttgatgtctgcaaggccagcttttttttttttttttttttttttttggagacaaggtcttgctctgttgcccaggctgcagtgcagtggctcaatgcaacctccacctcccaggctcaagcaattctcccacctcagcttcctgagtagctaggactacaggcacgcaccaccatgcctggctaattcttgcattttttgtaaaaatggggtctcaccatgttgttcgggctaaggccagctttttcttgctgatgcaggaagagggactggatcagactcaaatctgagaggccctggaggacccagctatgagaaactagcaatgaactagagcaggagggccaaaggcagcctgctggcttcttctcatttttccagcctctgacacctcacaccattatgaacatgtaattgacctgaatttgtaaattcttattcttttttttaatgatttctttcctgcatgaatggcagagggtgactcatccccagggacggggctcaacctttcaacatgaactcaccaccatgtaacgcgtgcggcccccactggctgaagccatttgataaatccctttttctcatttttacagagagaaggtctaagatccaagctacagcctaattcagccatttgccctttacccgagtttttcaatatactccacactttcttactcctgctgagagccccactttccttgaatgcattcctctcttggctccctccctgccgccggccttctccctctctctcccttccaggtcacttctcgtgatgagattggacttgtttcctggggctctggtaacaagttagcttaaaacagagaaatggaccctttcacagttctggaggccagaagtctgaaatcaaggtgttggaagggccactctccctctgaagccccagtagaggatccttcgtggcctcttccagctccggggtccctgacaccccccggcttatgcccgcttctctcccctcactgcctccgtcctcacacggccatcttctcatctccttgtatctcttctctgtgtgtctcttataaggacacttgtcatttgactcaggacccagcaggataacccaggataatctcgtcttgagatccatcacttactacaactgcaaagtcctttttttagatggaatttcgtgcttgtcacccaggctggagtgcaatggcacgatctaggctcgctgcaacctctgcatctgggttcaagtgattctcctgcctcagcctcctgagtagcagggattaaaggcacctgtcaccatacccgtctaatttttgtatgtttagtagagacggggtttcaccatgttggccagtctggtctcaaactcctgagctcagatgatctacccacctttgcctcccaaagtgcgtgagccaccgcacccagccagggctgctcttaaatgatgaaaccaatgggctctacagcctcaaatgctgagggtcaagctgtgtcctcttctgccaagaacaaggaagtggtatgtctgagtgatatgtcattgctcattgtctgccataaggttgggacaaagagcagagtctgggcctggctctcagcttagccagccaggcccccgggccaggctgagtcactgtgtcctcactgcttaacccagggtagcagtgctcactctgcttatcgcagggcaaggggcgatggagctgctatctgggaaacagtttgaaaactgtgaagggctccacaggcaaagtgccattctgtttgttttagtggggaatcactctaggaaaaaattaggaggattctggtcctgaatcctctagaagtgtgctctgcgactttgggcaaatcatttaaactgaagatagtaatgctactcaaaatcagtagtgtcacagacgtgtccacctaggaaaggtataaagtactatataaatgtgaggttctatcattattatagtgtttaccatttcagcaaagtattgtaaaagacattacataatgcatttgcatctttttactgataaaacttctactataagcattagtatttactaaccagcattttacattttcctttgaaagggcgaaattccttccgcagaattaaatcgtgtaatttttccaacagatatttattgagtgctgtgcatcaggatttattctaagcattgcaggaaagtagtgaacaaagcagatataattccttccctaatggggtggaatttgtgctgtggagacagagaattattaaggtaaaaaagcaaaagataaagaacgtaacgataagggcttaagaaaaaaaaactcattcggtgtcagaaaggagttgttgaaattttaggtggggtggccagggaaggcttcaccaaaggtgactatttagtaaagatctggcagcggtgacagtaggagtcacacggactcctgggaagacccttctagggagagggaacagctcaggagggagttggcctggtgcccagagcaggaactgaacatggaggcagagactcagtcatgtaactgctggaggctgagtctcagggcctccaggggcgtggcgggcttgggctcaggcctttcttctgagtcacacaagagctgttggagggttttacctgaggacggacaggctgactgccgtttaaacaggatccctctggctgctgtgttgagaatgggtatcacgtttagaagccttttgaaataagtatttgaatgcacaagtcatactgaaagtcattttttaaatgtcaaatgcttgccttttcccctaaactagagcaggtcattcttgcagtgaaatagtccactcacttttctatagtaggatgaaaagaaagaaacgagaaggcacgacttgctgtatctagtcaaacattcttgctaccaagaaacattcacgctccgagtggagaaggggctgcctgcatctcgtgccctctgggtgagcccggctatgtcttccttcaccaccctctgctgggagggtgggagctgaggggacaaggacacctgagagaggcctgtgatgggctgcccagtgccacccaagcccctactgcacatcttccgccccagcccaggttggtccagaaaaagaacatcaagtgttgttacccaattctggtgtcaaagacaccctaagagtcctccattgctactgaccagcagtttcacatgtacctacaaacagaaatggggtaattgggtttaataaaaaaaaaaatacattggccataaaaaggaatgaagttcatccatgcagtacatgctacagcacaaaagaaccttgagaatattatgttcagtgaaagaaggcagtcacgaatgaccacatattgtatgattccattcttatgaagtgtccagaacacttcataaatcataaggcaaatccatagtatcggaaggtagatccgtggttgcttagggttgggggtcggagggataatggggtgatagctaatcaaaacagctttgtttttgaggtgatgaaaatgttctaaaagggacttcgataatggttgtacttacctgtgaatattcttttttttaaatattctttttttttttttgagacatagtctaactcactctgtcacctaggctggagggcagtggcacgatcttggctcactgcaacccctgcctcccgggctaaagcgattctcctgcctcagcctcttgagttgctgggattacaggcatgcactaccacacccagctaatttttgtatttttagtagagatgggatttcatcatgttggccaggctggtctcaaactcctgacctcaagtgatctgcccgcctcagcctcccaaagtgctaggatcaatggtgtgagcccaaaggtgtgagcccaaaggtgtaagccaccgtgcctggtccttacctatgaatattctaaaaaccgttggattgtatagtctaaatgggttgctatggtctgaatgcatgtgtcccctcaaaattcctatgttgaaacctaacccccgaggtgatggtgttgaggtgggacctttaggagataacagatcatgatggtggggtcctcatgaatgggattcgtgcccttatgaatcaggcctgaggagccctttatcccttctgccatgtgaggacacagcaagaaacagagagcctcaccagacactgaatctgctggtgccttgatcttggacctcccagcctcccaaactatgagaaacaaatttctgttgtttacaaattccccagtcaaatgtattttgtcatagcaggagaagtggactaagacatggatcaattttatggtgagttatacgtcagtaaaggtgtttctataggtgtctgtcacacacatatgcatacatagatgcacaaacacacaaatacaatgctcttttgtgacttctaaaaaagtttaatcacaaatggaagtatttacactcagccaggagaatctgtaaacatgccctttcaattccattgtcaaacaagaaagaatggtttcaaggcactgagancagagtgagtacgacatggaaacccaaccctaccttgggagcaggggctgacaacccaccactaggatgtaccctgtgtatctgtagtgctggctccctgcacacagggcaaggtcccgtccaggaccatctgcagaatttgcaaggcccagtgcaaaatgaaaatgggcctcttatgcaaaacttattacaaatttcaagatggtgaccacaaagaattaagccaagtgtttctttacgcttttaagaggtatttccttgctagaactggggcaactcccatggcgttcagtgagaatcttccagaagatgagggctggtgtcctatgccttaagagctaagagtggaggtgctggccctcctctggttcttcaacctgcaccaaaggggcatgtcccaggtggtgaccactggaatttagaggtaaaggcagcatttgcctggagcagagaacacgaggtgaggcgggatgactctacaccacagccatagataagaggtactaatagctcagtcggtctgaaagagacacacttaaagtcataaatgggaagacgtgggtggaaagtcttgcagcaattggaaagccattccaccaaagacgtgttataacttaaaaatattccaacttctgaatgatttctttatacacctgcttaagtcggtgacattattcagccttaacactttaatccaagttttattttgtcaccaaaatgtgagttaagctaacttaatcatttgctagactgactggcacaggaatgactaactcttggtttgtgtgaagactagtggttcagtcttctagttagcaaaatacataagccgatgcactgaggattattcagttccatgcatactgttggaatcattttgtgattcagacaaaaacacacaactataaaatcatatatctgtacacgtctgactcagttcagacacatttatttagggattatcagttttacagaatacaacgggtcgttattactattttggttgttcagacttgcctaaagcacgtcactgtgcagtttgatatcatggtggattttcaagcggtttataccctcccagagtactgccttataagggaaaatgactgtgtcagggtggcagtgtgctggacgagggggcaggaggcctggagtgtggccccagcttcgccaggaaataggcatttgaccctgggcaaggaattgatcctccctgggtctcagtttctgcatcttacaaaccagagttggtctgagccatcagctctctgaagttttttccagttttaaaatccaatgtttcattttctcgtttctgaccaccaaaggcaagaaaaacatagtcaaagacaccatggttcccattgacagcactgggattgattttataccttgttgtcaaccaaaagtgccagtgcagggcagcagtgatcagcgatgcccgcaggagaccaagacttccagggccaggggacctgctacttatttatcacacacttaatgacacgccagacactgttctaagtgcttgggagacattaacagagggaggccccgaggggcccacaggtggcctgctagggaatggctgggcgggatttgaccccaggcagtctgggcccacaggctgcccttcagaggtgaagacggtagccctagctgggtaaccatgtcttcatgcccacagggagtgcaagggacaaaggaggctgacaaggagcagaaggaattagaaaggagcattagcaacgtttttgaccaccagcagaataccctatctgccattccaaggaatctcacagaaaagactagacactggccaactcttgcataatctgggtccaccctgatggagcaggaggcagctccacggccccacatctgcctaggattcttggtagctgggccagcctgcaaatgggcaaggttggttggattcggaggtgggcggaagtgtgggttaagcttatcaagtccttgaccccaacatatatcagtgaaatagccaccactgccagacaccccagcaggccagatgcaggcggcagcttacacatgaggaaatgatttctatctctaggttcattcttttcttcctccactccttaccaaagtctcactgtgcatgtgattttaactgaactgtgcacttcacttttacttcttgagggcgggaactaactaagccttaatcatatttgtcttctcagcatctgactctgtgtttgctaagtgaatgaatgatgcacttcggaccaaatgacgtctgtttaacttgcaactggaaaccaccacaaactgcctgttgactactgatttggattttaaggtaaatacagacatgtttctaaggagacgtttttgtgtgtgttttttttcaaaggatgacttcgtaagctagctaatcatttctcataattatgtctggattctaaagaattctttttctgcattttactctctagatatttcatgttcgtaacacatatattctactgtaatatcccttttcctcctctcttctgtgaatgtccctctttcttaaggggaaagtgttaacattgctcataactcagtctgccatagcgcatctgatcactccaccctgtgcaccttctgacttttaatttccttccaacaccctcgacttttgatctccaagcacaagggctatacttttatttattaggtttaatttactgtaaagctcattgttccctgtgaatcgcacgataacagtcaatgaataatcactggcttcagccagactgctttttaattctgctgagtaactggcaagccaactagtattaaggacaaaaatgtaaggaaccctgatattgccccagaactaggataagccattttattatgaacatgtgactgccctcgtgcagaggtggatcagctacagggcaggacccagggcaagggggctgcttggggcagcctcagactctttggaaggggaaatagggaggaccagggacctgggtgggaggcaggagcttaggcttacgatgaccccagcacacaggcccagcttcctcttcccacagcctccctgccgtcttagctctgccatttggtcttccggccgggatccctttcccaaggctttcacacatttaaacccgcgaggggcaggactttttttttttttttcgtgtatatgatagttttttcaaaatgttttctataaaatcctccctgaggagagcttggaaaaagattcttaatagctagatcattttgagtccttctctaccatgtactcaacactctaatatattctgcacatttggttctatgtcatttgccatagtcttaaggacgtaggttccataatcatcccttattctgtagaggaggcccaaggttagtgagcagaggaaggttccactgtcgggaaccggtggtcttcaaactcctgtgctcctcttttgatatctttctgctcatatatgttggaaacagcccagcatgagcaaagcaccacctcctagcccccagcctgtgccagccctgcaaagaggaaatatggctccactcagggagcccatcagcgactcagggagccctggagcacctggcactcagcacccatgaacacgagggcaggcatggtgggacaaggcagtctgcttggggcaagtgagcttcgggaagtagctgagctttggggagcagctgtctatacccagcttctcagggctgtgcaagtagcctgagggagaaagaccctatattagctgaaactgcagcccagatgagtcagtattttctgctacggttttttaaaaaaatagtaacatactcatgtctccatggtaacttactatggatctgtattccatttatggaactctttcttgacctatctgtgttctctaatctgggcctgaatatacactgagaagccatcagaatcaattcagtctccaagaaataatcacttcccctatacgtgattgtttcagccgtatagattctgactgtgactcatgccacggtgatacccggagaccttcggggaccagaaacattaaggtgcaccgatatctcaattatccggataactctagacctagagtcaccatggaaacctagaaccctgagtcacagagaagctgggccattcctctcccttcccggtggtgccgcagttcttgagatgtgagcagctttcagccccgtggcctcgcctaagctggggtttcctatttcatccacaacttcaggaatctaaactttcctgcaaaatattgagcatgtgacctgagtccaaacagccatggactcaagcaccttctgataaaaacggaaaccacagtgtagggggtggttttgaccagggtttcggagtcagataaactcaggtttccaccttgaatttctcatcaatctgacgtggcaggttattcatcctaaggttcagttcccacctgtgtaaagtgggagccgcaagtcctccgagagtgacgatgatgtgcgtggagtgcccagcccagattgaagcgcggccaaggcgggtcgctatctgggcaccgctcagctccagagggcgccactcccgcggagcctgcgggatcggggcttcccgggagcagcgcgatcagcaccacgactcggggacacagccagggcccggtttctacaggaagcgcctcatttggagcctttttgtgatagaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggcctcagggccagccggcgagggacccagccgagtgacagcaggaggcggagggaaggttgggccggaaggtgtcagccccgccccgcgctccctcgccgcctccgccctcctcttctctcccctcgtgcgttccctctcctctccctccgctcccccaaccctcctgctgcccccttccctctcctcccgcttctccccatcctgcctacctcccttcccctcctcttctctctcctccccttccctcccctctctcttctctcctccctcgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcagggtaagagctgggcccgcagagagcgcccggcgcgcggctccagtcccatggagggtcacccggggcctgggcgggggtcgcggggggcactgacacgcagatctcggggcgctgccgggggtgcaggtgggggtggcggctgctgcgaggactctaggggcgcgcgtctgagttccgcgccggctcgttttccggttatggagtggcctccggggctggcggggtcggccggggggttcctgcgtgctagggccgctgtcttcggggtcgcctagcggcgggcgcggccagggcgcgctggcttgtttcgctcgcttttgtttttaaaaggaaacgcaggcctggtagggggtcctgcccagtggatgtcccggcgaacatgatttcgcgaacgggagtgggggcacaggagagcgtgtccgaggtggcctggcgccccggctttgagggtgacttcctggagcggcgccgggcccggaggatctggggcgcccaagacacctgaaggctgcggcaccgcgggaacctgcggggcgcggggtgccatggtcacctgctcgccgcgtccagggcccgggctggggacccctcggtcgtgcgaggagagcgtggggaacctgtcggaaatgagatctggttgcgctgggctgcctttattttctcgttcctacagcatttgaatgaagaggtaactgagtgtttgcttgtgtgtgtttgggttgcgtgtgtgttatcctattttattttttacggcaggagaccttttatgttagcctgtacacaatttcagggtagcctaaaacagtagttgacgcgctagttatttagaaagtaaagaaatgagcagtcccctttggagacaggagtaatttattttaattcgccagtaagagattatatttgttccatacaatggaagcgcctgtgcgttatctgcctgcccacaccaccaccaatcagagagataaatctccacgttaagctttattaaaattctgagtagtagcgcagcacagtaaatgttagcaccgaccatccgcagggaaatgctcagatactcatttctgggattagtcattcatctctctaaactgatcgctttcaaagcgaaaaaagcaaactaccttcaaatgtgtgttacaaggttgtgttgtttcttttttttgtttgttttcaaatttatctaaataatcttacataagtgattacttgttccaataagggtactgttgtcaggcaaattctccttgtttttaaatgtaaccattctcagctgttacatttctgctctttatccttttttttttttttttttttggtttaaaagcagcgatccatcagcaacaccaaacttgaaattgatttatgtggaaaaacttggcttgtctgccatctaacaagccctgttgagtaaaataagcaagcttaaatttgattagttgtgtgtctgcctgaaaccatttagtagagcactttaattctgcatggtttttacaaaactcattaaaagctggacaacaaaagaattctattctgtagctagtaattacagctctttatgtgggagtggtaggctgccttttctcctggtatttgtacacaaaagctggggagagcttttccactgccttccacattcattctctgtccatctcagagaagctgaaaaacagaatcaagtcagcaagcagtctgcaagcctaaggaagaaaaagagctgacccatccggctctggatggataactggcaacacccaagatgtctatgattttggccttctgtttgaggcttgtttatttctttaatcagcagctaccaggacttatttcatgcagagaaatgacataaagctctagaggaaggagcatttcacattggaaggagtagtgagaagggcctgatctgataatatcaggatgggtgggaagggtccattcctcatcattcatgttctcccggcacagaggactgtgtggaggactcaggatttaggaccatactcaactggggtttgatctccactttgccctgcggtggcccctctggtagctatgtggatcctgggcagattgtccatgttgctgggcctccgttgcttcactgtatgacgtctgcctctcagggatgcaggaagattcaattaggtaggagtggatggtcccccagcacggggcttagctcttagtaactaggcattctggcaatggcagccatcaataggagagactattgattgttgagtgaatataagtggcataatccaccaagtggagattctgagtgaatgtggccactttggacccaagactgctgcccctctctgtcctctcataggactaatatttattgccagtgctgaccagcctttgttggctaccatgatcattacctgcactccgagtgttttaacagaattttctgatgcctctggcctcacctgctgccttttagccaagaggggtgtgtgtgtatgtgtgtgtgtgtgtgtgtgtgtgttgggtgtgtgttgggtagcagggttcttggaaggtctggtttagccataatgttgatcataaagagaaaacaagaaaataaatgcaaattaaatagttcggtgagcctttgttatttcgccacatccagtaagttctatcagttgaatgttgtctgaattacttaaaaagttctcagttgtaaacaggtaagagcacccagtggaggccatggagctaggcttagagctttgccaccagccttcagttccatagccatgaacctgggagggcaaggaatcaccctagaggtgaaggccattcatcggtgctaacccaaggtctctgaaaatgagttttagttgctctgttatctaagtatctttcttactgatatgtaacttacctggctgaacaattacattttagagctccaaataaattttcagcctattatgtcattgtccaattacaagcctcattgtaatagccatgttaaaaacaataaagccggtgaaattgatttcagtgtatttcaaattaacctaatatattcgaaatattatgtatgtataaaaattattgagcttttttcttttttccactaagtctttgagagctagtgtgtatgtgtggatttgtactagccactggttgagagctctgtagccacacatggcaagtgggtaccatattgcttagcccaggcctagtagaagattaagactcagtcagaggaagtaaggcagatccgtgcttggaatcagttcctcttgaagaagtgcacagccaagcaacacacaaagcagaaatattttgagctctgtattcaaagcaggaagatctgggaccatgtaagggggtttggtcttcagttctccctttgatcccttccctgggtgtgtgctttcttacagcctggagagtggaagggaagagagggggcttcctggactcctttcctgtctctagaaatgacccctgcagctgtcctgaagctctcaggttaagctgattgtgtccagagcagacaggaggcggcccactgccccactgtacccacccaagcactcacctaagctggccatggaaatgtgaatgaaaagcctgacccaggccctcttgccctgctaacccagcaaggaggctctgaccagccagccagcaagtgactttttctgtgacatctaagtggaattcagtgaggaatcagcattattattcaatcactgaaacagcatatcccgttgtgatactgagaaatgctttcctcttgagacctttgggaggacagccatttaaacaagaattccctgcattcacttttgaattacctgttagctgtagaactcagccaggatcaagtcttgatgccaccaatgatgagtttagtgtacttaatcttttgcctctttgactttttttttttcttttttaagatgaatgatttcggaatcaagaatatggaccaggtagcccctgtggctaacagttacagagggacactcaaggtgagtgggcaagtcttaatttttttttttaattggaaaactcgatctctaggaggaaagaaaaaaaaggcctgggtcccagaaaactggttgtagccctagcttcttaatttattggccatgtgactatagactatttgcttacttgctctggtcctcagttttctggtctgcagaatgggtatcttgatgtgtgttgttcttctcctccacgatatgaaaccaaaggcctttatagcttgttttctgaggctccttccaggtgaaaatcctataactcccaataaaacagctggagaggctgtctctactgccttttctgtctacccaggagtttccttggttgatgggaagctgtttaagaactgaaatgagagagaagaggcagacagacccaaccgctacagctcctatcagaaagggcagcgcccgtggaattgtaggtagcctgttactggctcagagaacaagcaggcctacttatgttaaaccaaaaaccagatgaaaaatgaaagcgccctctctgctgcataaacattttatgtagcttctatcatcattccttttgggaacattctttagtagcacaaactggtaatctcccacttgtcttctccaaatatgacagcaagatttgattgttttcagtattatgtagtaaacatgtttcagaagcatgattttaaaattggcctcctcaaagtttagcgtcttgcataatgatgatgtacgtctctggcatattacattttcctttgtatatcattattgaggttatttgtctgatatgacccaaagaggcaaaactcagcacagtcctttctgcagtattctaaaggtcatcaaacttcagcctagtgagtctgcttgtttgatttggccggacattttaagcatggcagaagtggtacaagaaatcatggtattaagttgaaaccacaccccttagaaaaatccttctattaattcaaataatttgacgatgcttatgcggtttctgaaaagaagcagtcgttgctgaaattgatgtgttgaaataggaagcacagatttgtattgtcttttggcttcctggctttaaaaaaaaaaaaaaagaatttacggttaggaaaggcatttcttagtcacctgggcaatgcttgtgggaactttaaaagtttattggaggtttcaccaaaattagctctgctctaaagtagtttgtaaatccagatgagtaatttgcacttgcctgattgatcggttttcctcgtagatctcaggcagttggtcatcattgacttggatttttttgggctgggctccagcctctgcctgccctcttttgtaatgcgtcattcattgttctgcatttctaaaaagaaagcgggtaaccgattttatttgtaaatgtgttacacattttcttattgatgactcaacagatgggtcattgtattacacataacatgggatttccagcttatgttggaaaaatatagtctttcttcacgtgttcctcaacaatttaggcgatgatgaatccagatattatcggttactttcaaatgagtcttacattaaaaggtatttctttcataaatgttatgtaagatgctcagaaatcgagttagtgtaaggttttatctttctgtgtgtctcttcttttctgcagatagtttagtttaactttaaacctatttcctttggaaatctttccccttagtaggtgatttgggttttttttgttttgttttatttgttttttcgtttttggttttaagcaacagggtccttctctgttgcccaggcgggagtacagtggcttgatcgtagttcaccgcagacttgaactcctgggctcaagtgatcctctggcctcaacctcataaagcactggggttacaggcataagccaccccgcctggcctgggggcggggagggggttcatttttaagacactttacttgttataaaatgaaacgttaaggaattttgtcatgtattactattttccaaaccattggaattgatgtggaaaagcatctctagtttcagttaaattgtttcatggcaaacatttcaaaataaatgcttccaaagataaagtagtgtatttcattgtttgatttttcagtgtttatcgggtcatttgccttttaactgcattgtgctcagacggccttgtcaagggtcatttttcttacacacacagcctagttgaatttttctcaatgtaacaggagggtcaggtgtttggtaaaggggtctctgaggctcctctcgacaccattgtaagattctgttattttcagatttgtgtatttaatatattaacttaagtggattaggccactaaaacaaattcccagtcactccgactctgtgaggttacttaaataaatccacagtggccgggcaccgtggctcacgcctgtaatcccagcactttgggaggccaaggcgggtggattacacgaggtcaggagtttgagaccagcctggccaacatggtgaaaccctatctgtactaaaaatgcaaaaattatccaggcgtggtggtgggcgcctgtagtcccagctactcgggaggctgaggcaggagaatcgcttgaacccaggagggggaggttgcagtgagccaagattgcaccactgcactctggcctgtgtgacagagtaagaccctgtctcaaaataataataataatccacagtaaaatacaatcatttcagtcactttgaccattttacgagtctgttttaaggactgactggttgattccatgtttgcttcaaaattgccagtttaatcagggactattggtaggattgcccacagaccacttttacaacaggtaattcaatcagtttaaatattgtatttccattttttttccatctgtttttgcagcgccagccagcctttgacacctttgatgggtccctgtttgctgtttttccttctctaaatgaagagcaaacactgcaagaagtgccaacaggcttggattccatttctcatggtaattggttcctcagacttgacaaattgtgcatgattttcctaagtagttcagttaataaagagatgacagttcctaagtgagaaatgttggtatctggaatctttgatatgaatagccagaagttctggacctgggagaaggcagtttttcatttgtatcaacttggtgattctgatgtggattctgatgtcttgagtgccagacgccccccagtgagccgctgttaggaaactgcaggggaacccctgagctgcccctcctggatgttttcaacattggcaagcaggtcctcatctccctgctctgccctggaaaacagacagaagagtagacattaaaacacacccaaacttgtaatttgggtttgcatcattagttaaatcatctcccctgccctgagttttggggcaacaaattgttctttgtaatccttacccatcggtagttctttctgtagttcttcgtgtcattgtttattcttcttaaaggaatagcacgtcagataatgttcatacaattactgtgacagagctattagttggaaacatgccagagatgactgtgtcatgtgaagtaggtgctgagaatacaggccagaaaattaattaaaacgcatacactggcgtaagcataaccctgcatggcagccatttatcattcttgaaattgctgagggtgtctggagaagattgtttttcaataaaaatggaaggtgtggttccattaccgtgctaagtgcggcacattcatatcacactcacttctcagctctacgcctagtttaatggaagtgacttccaaatgatacagtcccttcagccttttgaccagaaaccatgcaactgttttcattgcctacaattttaaaatagacttagcagttttccctacgcacaactgctttgtgacgctttgcaaaatagaatcaaatctgagttttattttagatttttttaataagtatagttctgagatatatattttctcaattatagtcagaaaagttttttgttaatagttacactgttttaaggaatcatgccaaggtttgagatcaaaattgttcttttccaaaaactaagatgtctctcctaaatctccacctgatatcaccaacttgaagtcctaatgtccccatggggggtttccttccagactccgccaactgtgaattgcctttgttaaccccgtgcagcaaggctgtgatgagtcaagccttaaaagctaccttcagtggcttcaaaaaggaacagcggcgcctgggcattccaaagagtaagtactgctttcctgagcctgcactgggtgagaagaaccaacttcagtgcagttgtttgatcttgacttgtttattaagcttttgcttggggtattctgcaaagagtagcatggatgtcgttaacctgagccagtttctgtttcaccccaatcaacccaagacttgatccagaactcattaaatatgtagtagaaggacgcattactggtgtcttgaaatgtgcctgggtcgtgtcagaatggtgacgtgtcatcatggtatcttgctcattcgtgggttctggtgtatgtcggtacttggtgcataaattagggatgacagtggtctcactacctttccactgtttttacctcatgtgttccattttttcttctctcctggtagacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaaggtaccagctgaacgtcttacttctccttgtccaggatgagctgtggccgggaagactgattgggaaagtcacgtgggtgttcttcaaccttagggttgccacttgaaatgacatagagtaccttgcctcaaaatgccactcaagtgagtcagatatatggcagtgattatagatttttatcccactttatgtgagtgtgtgtgtgtgtgtgtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttctgagctcaccttacagagctaagagatatggcagccttaatgaaaggggggagcctttactcacataaaccctgtgaattctactgtaaattttcctacatccaaatggaatgtattttggatgttgaggattgttgagggggcggggtctgtttttaaacaagtgagaaattgatatatatttacacgctatcatattgtacagaaactggccattgatcagtagaaatctcaccaaatacagagaaagtcttgattcaaaacttaaaatagcagggagaccaatgtttaaaacatgttgagttaaaaaagaaaagagggccaggtgcggtggctcacacctgtaatcccagcactttgggaggcggaggcgggcagattacttgaggttaggagttcaagaccagcctagccaatatggtgaaaccctgtctctactaaaaatacaaaaaataaaaatattagctgggcatagtggcacatgcctgtaatcccagatactcggaagcctgaggcaggagaatcccttgagcccgggaggcagaggttgcagtgagtcgagatcacaccactgcactccagcctgtgggagtgagactctgttgaaaggaaggaaggaaggaaggaaggaaggaaggaaggaaggaaggaaggaaggaaggagggagggagggagggagggagggagggagggagggagggagggaggggagggagggagggagggagggagggagggaaagaaataaaatacagtagggattatttaggttaaaaaaatataagaaaataagcatgtttatagaattcagggaactagtcctcacctgactgattttaaacacactgaatttcagcatcaactgtagactcagaatctcgaaaacacctaggattcaacagctaactttttttagttacggcgtctgagggccagggaaactcatttttaaagaccctcatttcttctgaacttggacagggcttttctaccaagtttctggtgatctgtttattggcaaattgggcctgttttaccattcctcgggcctgtgagtttgtgtgtatttgggtttccgggtggacgtgcactttgtaatatattcgtagtaagtatgcatacacagtgcacaaaccttttccctttcaaagttcttgggcacatgtgttccccatcccagactcccacagccctggagacttcccacaccctggggaagcgtgcaggtttggaagcagtggaactgtaagcttcacgggggcagacaccatccattttattaatttcctgtatgcagcctctggtacagatggcatttcataaatacttaactgtttcttgaatgcatgaatgaattcaatacaccatctggaccttttgcgatagaaaatttagtgttgccaatgacatcattcattttggaaaatttattttagtaattggaaaaatgggttgctttctctcgttttttgaaaaagacaggcagggacgtggagcaccatgagattaaatgtgaagcactccgtgcatctcatcattctaaaattatcatctcacaggaattcagaaagtcaatttgttctgtgtagttttcacctacatctgccatcttacgtctcctgtgtctgcttttcagaaaaccaagaaaagacagaagatcaatatgaagaaaattcacacctcacctccgttcctcattggattaacagcaatacattaggtcagtccgattgattctgcccttaagaactttgtcttcagtcttcccagtagacttggaatctctctactgtaggctcctaaggggccacctagacctgtgtgtctcttatggtggccacacgtgggtgttgagctataagccattgaaatgtgactggtccacatcgagatgtgtaggaagagtatagtcatgcacaccagatttggaagtcttagtatgaaacagagaatataaaatgtctccctgataatttttaatgtattgattacatattgaaatgataattgctatatgaggccaagtaaaataagaaaattaacttcacctgtttctttttgcttttttaatatggccactagaactttcgcagttgcttaagtggctcacacgatcttccataggtcagcactgttagtgctagtccaggcaattcttagagcaaggagcagaacgaagtgagctgattaccgcagtcaccagtaatgttggtttagtgtagcaaacaagaggcggcaggcacagagtgcgtgaaaagcaatttgtaaactggctctgaacttgggagcttaaagagctgtcatggaatctgggtcctttcttctggttgctgatactggggagggcacagggtctggccaggccagcgagggaggggtcctcggaacagcaggcttgggtggtgttggtccggcccagtgttttctctctggccccagctccaccattcagacccggtgaagcccacctctctgccccactgggggcttcctgctcaggaggtctttctgaacatgacagtgggacaccctgtgcctgcctgaacctgaatcagagtcagagagcttccttccctctccagaaaataaattattctgcaatgaacagagacaggagcggtgtgatgaaggagcagaaagcagagtgggctgtgcctcagcacacagggttcatggcctggttctgcccttatgaatcacacagtacatgacacgtcacttggtctgtctgagccttactctcctcggaagctaaaagagccagtgagccctgtcttcctgaaggtcccatgaaagcactagggttgtagaaataggaacattgagtcctgcctgcagaggctgcagtcattttggcagagggctgctggttgagaagctgaatggtttgagaagaaggcctggtgacagacccccaccaaagcccgggtctccactgaggttctgcagagggctggagtgtgcggagtgctcacctgtcatttgctcgtaggggttagttactggggtaacactgactttaagagctctgccgtccgattgttctgttccaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctggtaagattggaagcatctttcaacaaggctgttgctttgattctgagaaccccagagccataatgaacctcttaataaatacttcctggattcagccattagagaagggggtcaaagcccatgttctaagtggatttccaacaagcatacccctaatatgtttcaggcactggcccaggtactgcaggcattgagtaaacaaaacagtccctgctcttacagccagatttctccacactttgggatatttatggaggcgatgcaggaatgtgacatttcttcttatggagatgtaacataaatacagtgcacaagtctcaggtcatgtggctggttggatttgtgtatgtatgtatacccatgtaataaccatccagatggagatagagaagtttccagtagcctggaagattccttcgtaccccttcccatcaataatgtccccccgacagaagggaacgattctgacttttatcattacggattaggttttgattttcttgaactttacatagatggaatcataaggcatgttttcttttgtgtttgtcttttactcatcatgtctgggattcatgcatgttgttggatgtagcagccatgtgttctttttcatcgctgtatagtattccattataagaattttattcattctactgttgatggaagataggatttgtgtagtatagttaccctaaggaataagcacctgagtagagagcattttgagaagtctgagtggttctacaccagcaggtgcatgattgcactggtagtggttggtgatgctatggtcgtgcccaagaccaactgtgtcctggaggaatcaaagtatgtgtttggttgtctttgccagggacgcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccggtggagcaaggcaaaccagttatacctgcagctgtgctggccggcttcacaggtgtgtgtggaactccgagagcctggccgcccagtctcctgggtcctgtcccttgcttcctttcgagccacagtaccacattcaccgagggtgtttctaagctaggtacaccagtgctctacactccatgttttatgcgtggcttgctgtatctctgaattcgacaaaagccacacttggaggaattttcatgtacacagagctccatggaatgagtgaaaatcgacaggccactccctccacctgggacgttctgaggaatagttggagcaggggacatggcctgtgcagtcttcagccctgactcacccactccaagaatctcaaagaatgtaaactggcttagggaggggcagcagagccagtctcaaataatatgggcactgtttaccttttcttgcttctaaaatctatctgctcttatttttgaggtttgggtgagagctattctaggcagtggacaaatataaagctgtttttagaaacaggtatttccagtactttagcgaaaatactggggctttgttttcactgcttcgtgtatccttaaatgcgtttttgtttttgtttttttaaccatatggagccactgtggattgaaattacctaacttaaaaaaatctgataagtttaaaataaggatactgaggcattcattctttttctgtcatctaagaacaatcagccacgtaaacgtattaaaatacacggaaagagtgtgtgaaagccattatcggtttcattattgggagtttagggcctgagaagaataaacagccataacgttagtgtggttcattttaatagtaacataagtttctgtttattgactgccaactctgtagttaagtaggcatacagtctgtaggacagcctggcatgggggcggtatgaggccattttacagatggggaaattggctcacaggcagacagctatcggtgctcacacagctctggttctagaatgcctgtcccgtgctttacagcaaagctttattgataacggccattgcgtttctgaggaagagctatttggtagaaagaggttgggcttagggtcggaagatctaggctcttctcctgtttgctgtgatgggcgtgtgatccaggacaaggcacctggcctctgagccgcatcttatccctcctctttagaacagaaccacactgacacctgctttgcaaggtggtagttctaaatgtcaatcgaggacaggtggacgagaagctcttggcaaagcatgcttcaccagacagaggctgtgaggcaacgggtgtgaccccgcgtggctattgagtaaaccgggctcacattaagcaatttacacatggtcatttggcaggaaggtggcatgggatcccacgtatgacacgcctcattctgtgatgaaacaccccctcagccacccccatctctgccccactgggtgtttctagaaaaaaaccttgaaggtttttacataaggaacaattaaaccagatggggaattttaatgccaagagttggtggccctaaactttcttccagaaagaacaaacctagcaatcaaggggaagagtgtctcgcctagtgaccttattttctaggagtaggcagtgtggagcaggaactcacatttggtgccccgccccatcccgttaaagcacttagtactgtcaccaacaccttgagtgccaccctgagtgtaacatcggaaccccattcagagagttgggtctgcattcctaaatcagcatgtacaattaggatggttaaagacttgctgtattttacatctgtgaaagggtatgatccgtctccctccctctccccgcaggaagtggacctattcagctgtggcagtttctcctggagctgctatcagacaaatcctgccagtcattcatcagctggactggagacggatgggagtttaagctcgccgaccccgatgaggtatggccagagccctgggaaatctctgggcttgaaaacctgatttcctgcttgcattcaaaaactcagttctttgggcacaaaaaagggttcaccagtactgctgagaatctttccacgtgaggcatccttggctgttgggaaaatggaagtggagtcattgctttgttgataaacgtgtacagtgttttctgggtatgcttcatacaagggcgttgcacagatttcactgtcttgatcagttgtctgatcaagaggcccaagctgcaaactgaggttctctgccgaccatctgaaaatgccttaggaaggctgcccttgtccatcgggggaacaagcctcatgtggccccgagccagccttctgtccactccttagctgagcccagcagtgttgaccccagccctgcagagttagaaccaggagccctgtctaaaggagaaggccaagggcaggtgggataccaaccccgccagaaaagcgttagagagaagcccttggtctctggcactggggagcgtaatctgtcaccattcccaccccgcctccagttcccttgggagacaagcattgaggaatgagtatatcacacagctcagaatcccacttggcacctgttaacttcagtagttggaatatccagcctggagggtgggtgacaccacctttccctggtctcaggaccctcctggctctgaacccttggctcccaggaggtttcactgagctggggccagggagcagggacctcattccccagtggttctgccccttggggacacagtgcccctaccataggtactcaaaggtactcagaggtactcaaaaggtcctcctgcggaccttgtgtaggtgtcaagttctctctagagtgaacatgcctcagaatcataatcagggaggaatgtcattcactttttcttcattgacaaattgagtttaactcttttccatccatgttcaccaaaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaattctttgtgatagtcctcgttcttcctctccacacccagcatgaaggagttggaggaaggatgttaaccccagatccattctctactcaaaacattccatcatcaagcggcaagtctctgtttaactggtttatacacaagtcacttagaaaccacaacccaaattggaatcaactttgagcccttcctaaaagaattcccaaaaagtgctctctttcaaaacaaaaaattcttttaagaaagtgttataatagaaagattcaaatgtctttctttgccagaagcttggcagagataacagaggagagattctggaatgtttatattaagtacattagaatttgaggtttaagtacttttggaactgaggccacaacactctgtcccctcagtggagtctgacattggtaaggtgatggtggtcttaggacacctgttttcaaatttgttctctttacatgctccaaaattagtgagtatgccaaaaagcttatattcattggtgcgctagagccagctcactgtgttctcccgagagctacatgtcccttcccatcatcgcatcagtaatggtagcttgagatggggcgtgatgagagtatttacaccatgggaatcagcagacactacaaatcagggccttctctcccccagagtgctgattgttaaacatttaccaacactctactggttatatctatcaataatttccatattagaaattaaagtaaattttaaaagaattcatttaaaaataattttacttattggcattaacagcatttttttcttgcaaaaagtaattattttttaaaaagttagcatggcattgtttcacatttgcaaatctctttaatgtctggtttagtattagagctggattcttctgtttctgcattcaatctgtttgcatatattttgatagagtatgtgaagaaaatccggcctaacagatatgtaacagaaacaaggaggagcatttaagactatttcagataattgtagatattctttctttactatgccaaaacttaacaaagtataattccttagttgcaattcaggtatgaaaccatattaataaactttcctaaggttacattaaattccattggcctacgttgcactttgaacagatcttttagccgtgtgtgattttgtaacatcctgcattggtcacttggaaaatattgcttcaaaatgttaacacatttcaaaatataatattcaacaattacattacttaatatcaccacaaatcacatcagaaaattactgggaaactatcaaactcacagtggtggatacacactttttaaaattcaaattttcacttgaaacctcaaattttataatcagcaacaaatacccctaagtatttgaggagagattctcggatgtttatactaactacattagaatttgaggtttaagtacttttggaactgaggccacaacactctgtcccctcagtggactctgacgttgttaaggtgatggtggtcttaggacacctgttttcaaatttgttctttttacatgcttcaaaattagtgagtacgccaaaaagcttatattcattggtgtgctagagccagctcactgcgttctcccaagagctacgtgtctcttcccaccattttgggggggaagcgacaggctcactttatttagtttttgaggaaggaccagccaaatacccaaatcagaataatttgccagttattctctcagataaaagtgatattcatgaatagagtggacagtttagcttgcaactcaaatacacaattgcatctccttacaacaatcaccatatttcagtatgtgtgcagaccagttctttaagtgtactttccattttattacacagaaattaaaaagatgtgttttccattagtaaaaaataagtttttactgcttcatcaagagcattcttgaggccaggtgtggtggctcacacctgtaatcccaacacctggggaggctggggtgggcggatcacctgaggccaggagttcgagaccagcctagccaacgtgacaaaaccacatctctactaaaaatacaaaaatcagccagatgcggtgacacatgcctgtagtcccagctactttggaggctgaggttggagaatcacttggacctgggaggtggaggttgcagccagcccgggtgacagagcgagactctgtcttaaaaaaaaaaaaattcttgagtgaaactcttattttttcttttctttttttctgcaagtgcatggtggtggtggagagtgcagtgacacagtgactgccaactgttccggttcacgtgattctggttcagcaccatagtgcaaaaccacctgtgcttttataccatcatagcaaaggtcaaaaagtcaagcgtggatttgtatccttgtaaaaatagtcttaaccttgaggatccttctgaaagggtctcggagacctcagagtctgtggggcacattttgacaatcgttctagaaagaagagaggctcactcagagcaaaagtggtggatctctggaggacaaagcgaaggtagggaaaattagcctttggcctcccaaatccagtgtccgtgcttccagtcttctgaccttttcatagccaggtaaggaggaagcatttcttgtttaaatcaagaagaattgtctagtctgcatgataaagaaaagttccttcacacagggtgaaatggatactctcaaagcccttttcctgccatccttctatctttgttcttttccatgctccagtccaattccaaatctgtttcaggaaacaaaaaatgtatattttgccacttttttttgagacagggtcttgctttgttgccaaggctggagtttagtggcatgatcacagcccactgtaacctcaacctcctggactcaagtgatccacccatctcagcctcctgagtagctgggactacaggcatgcaccaccagacccatctgatttttaaatttcttgtagagatggggtctccctatgttgtctaggctggttttaaactcctaaaatcaagggatccttctgctttggcctcttaaagtgctgggattataggcatgagccactgcacctggtcttgccacagtttttctgaaacttagaagaaaagaggaaagggaagggaaataagtatttagagaaatcatttttcggaacatcttcaaaactgggattgtgcagagatgaagtcatggggcctgcctgcccgccttttccatggcggggaagaagcagaattacatttccgtcagttctgccccacatcctggctctcccccatgtcctggctctccccaacatcactcaaccagctttatttatttatttgtttatttatttatttatttattatactttaagttttagggtacatgtgcacattgtgcaggttagttacatacgtatacatgtgccatgctggtgtgctgcacccactaactcgtcatctagcattaggtatatctcccaatgctattcctcccccctccccccaccccacaacagtccccggagtgtgatgttccccttcctgtgtccatgtgttctcattgttcaattcccacctgtgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttagagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctaatccatcttgaattgatttttgtataaggtgtaaggaagggatccagtttcagctttctacatatggctagccagttttcccagcactatttattaaatagggaatcctttccccattgcttgtttttctcaggtttgtcaaagatcaggtagccgtaaaaaagagaattttagaccaatatccttgatgaacattgatgcaaaaatcctcagtaaaatactggcaaaccaaatccagcagcacatcaaaaaccttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtatcgatggaacatatttcaaaataataagagctatctatgacaaacccacagctaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgactgtatatccagaaaaccccattgtctcagcccaaaatctccttaagctgagaagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttataagggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactacactacaaggctacagtaaccaaaacagcatgatactggtaccaaaacagagatatagatcaatggaacagaacagagccctcagaaataacaccctaccagctttctttcctgatagggctccagaactccacatggtggacacttgtcactgggaatgattcaggctttaatggggctgctgggcgggagcacagggcttgagggccagaggaagtggagcaggaactgtggcaagaggtagagggagcaagctgccccatcacctctcctgaaatatcaagcaagttaacaggaggatttgttgtgatttggagatggaccttggattatcactgtcactgggtctgtcaggcactatttgtgaccttgggtatgcaatttaatcactctctgcctcagtttcccctccataaagccaggtcatttgtggctgttggggggattgatctattgggggtataagattgtgtaaagtcagtaacctgggatgggggtgctatttgaacagagcacgccaaggaaggtgtgtttgagccaggggatctgcaaagaaaatatggatcccagacaatcatgtctccattttcatcagaagaaatccaggggcagagttcagtgatgaaacaagtacttaactgaaccaagactcaaaccctggtcttctgttttctggtgttgtcctctggccaaaataaccctgtcatgtttggttgaagtcattataaatgctgccccagatgctacctagggctccttcaagtttctagttcctccttccacaaaccagaggccacagcccttgatttgaattttaaattatcaggaacctcctacccaaagaacacacagccctcatttacagcagctgctggcagctagctgagttcgaacagatgcaagaatctcataatctgggccagatattaatctgtcttttctgtaacagcaaaacagaagggtgagtcttgaagcagtgcagggggaaaccccttattgtgcaactcttttgtaactcctgggcggagtctggacatgtgacttctgcttgaaatttaacattaggggaaagaccatttttggtcatagctgaggtgatgacatcttggcaactggaatggacatgacctctgttccatgtactatgagtaactgccccctccccatttctcaaagtcatgttcagatggcaaaactgcctgggattaccacatctgactcttgctagctgtttctgtgtctatggcttcatactgtccagacatagacctggggctcagcacacatgtatgtttgagtggcataaggtcagaagcacagatccagcaaagactgtggcccggaggaaggtgggttggttggaggaaagaaagtggaggtgggagcaaacgaagataagtaaacaaaaaaatgagctcttaagcaaaaaagattgcctgtctgctgtagcctgtaaagctctgatgagaaacacttttatgatttgctggtaaactccacccaatttggttctggaagaggttatttttcattgcagtgtaagcatgtaattagttaattgggaaatatggcgccattttcaaagctcactttcatctgtcatctcacttacacctccctgtgaccctgggagattggttttattatgcccattttacagatgtggaaactgaagctcggagaggtgaaccccctaaaaagaaattggagaggcttatcctgactcatccgtggtccctgattccttgtgcctgagatgcagactgtggcttgggaataggggagggctcagagggctggagctcagctgagtggccggatgttccctcacagggtaccctcctttggcttcctgttgaccctagtagttgtcaatagtgctgcaggtgctccacgccttcccaccctctggatgaagctcatcctaaggaattagcatctcatttctaattctcaggtcctcaggaatcagacttgtattttgggtcaaatttgcataccttggggcttctgttttctcaagctatgtatggaccccagagcaaatcccaaccatggttcaatatcagcctctgggaatctgcagatcactggaagccaggctgcccacgctttctggaagccacttcctagtgaaggagccctggaggaaagaggcaatggtataggagtctccctaaagtgagaagtgtggagcccagcacttcaactatgtctgtgggtggagccaaaataaccagttgctcctgatcgctgcatgtcagcaattgtatcacaacaagaggccacagggcatcaccctacccaacactgtgatgggggccggggtcacatgtgcttaagtgtctctgtaaatcagcccttcagttgggattaagacagttcaggatcccaagaacacacatgcacacacacaacccacttgcacatacatgtgtgcagtcacacttccagagacacacatagacatacatatgtatacacacatgtgcgtgtgtgcacacaggtattcacatgcacacacacacgcacacttatacactaacacacatgtgcatatgtgcacgcatgcacacacacacacacaccccactccttttgcttgcttcaccttttctgtctctgctcctcctggtggtcatcacctcccatgccctgtctcctgtatcaatgccccaggactacctactataacaaagtgtcacaaagtgggtggtttaaagcaacagaaatgtatcctttcacagttctggaggctagaaatccaagatcatggtgtctataaggttggttccttttaagtgcagtgaggaaagagctggctccagccctctctcccattggctggtagatgatcatcttctccctgtgtctcttcatgtcactttccctccttgcccctctctgtgtccaaattccccctttttataaggataccagtcatattgtattagggccagatctaattatttcattttaactcaattacctctgtaagtaacctacctccaaagacagtgtcattttgaggttctgggggttaggacttcaacatatcaatttgagggcacacaatacagcccatatacacctcaacactaaataagttacatggtagttctatttttacttctttgagaaatcttcatcctgtttttcgtagtggctgcactgatttttacttccatcaaccgtgtgtccccgtcttttgatatgtgtgtatgtcatatgtcttcttttgataagtgtgtattcatgttttgaccactttttaatgggattattattatttgttgttgttttgactgttgactttgttgaggtttttgtatattctggatattagttccttgtccaaatgaatagtttgcagatattttctcccatccaaaagggcatctcttccctttgtagattgtttcctttgctgtgcagaagcattttagtttaatatagtctcatttctctatttctgtttttgttgcctgtgtttttgaggtcttagccataaattgttcgcctagcgcaatgtcctgaagtgtttttgctatgttttcttctaccagtttatgttttcaggtcttatgctcaagtttttaattcaccttgggttgatttgtgtacatggtaagagataaaggttcagtttcatgcatctatgtgtgagtatctaattttcccagcatcatttattgaagagggtgtctttttcccattgcatgctcttcattcttttatggaaaatcaattgactgcaagtatgtggatttatttttggtttgtctattccattggactatgtgtctatttttatgccaataccatgctatttgggttaccaatagccttgtagtatattttaaagtcagatagtgtaatgcctttttcttttttctcagaattgctttggcctttcagactcttttatactgttttttctatttctgtgggaaaaaatgatgttggtattttgatagggatttcattgaatctgtagattgctttgggcagtatggtcattttgattatattaattctttcaatccatgagcatgggatgtctttccatttgtttgtgttctctttcattttttttttttcattagtatattattatttgtgcagtgagcagaagcaaagtcagggacactgtttgtagaacctggctgcctcccctcccgcagcccagctgattgtcctggttgccaggcgcttgtttgcattagagacagaacactctgcagggttctgaatggttcattgtggcccttaggccactggcaagcagtggcagagccacggaggggctgctggtccccaaatgtctctccagccactctggggctggtgggggctgccctgctggtgatggcttgagagaagacctgggggtccctgggcatcctggggaggtcctggtttgtgctgctgtggtgatcttaatcatcaagagatgacacactttatgacacacgaaaagaactgagccaaacactgtttccatcaagaggtccatgtagaaggcagccagaacgtgtagaaggatggaagtcaaggcacaggcccaggaagccttcaagtcacccctgatggaggccagaccttgaacattataatccctctgcttgtcaaccattaatacaggtcttccctgcaggacataggaggctttctgggaaaagcatggaaaaaacaagcctactaaatgttctcaagtgactgatgtaggacacatcttaaaaggatcaaaggaggatgaagaaaaacttcagaagaaaataacaggtggtttgaatgaaaacactcattttgcagaaagtccagaagtgctcaaccaagaaattacaagatggaagcaaagagtacagaaaaaggaggcgaaagaaaagctggaacttttgaatgcacaaataaaaaaggtcatgaaagataccatgagccaattaaaatctatggctgaaaacctgctggacaccatgtagttgcgagatttccctagagaccacggtgacgagacctagaaaacagagctaaagagaaaagcagaaaatgaagaccgcctcccccagccccagccctcccaactgtaagtcagaagagttttgctgggtgatggtgacttaaatatgtcctgtgaaagtcaagaaaaatcaagaaatagccaggcaattgtgggaagaaaatgcaatgaatgagagctcacaggaaaaatcaaatgcctccaaactgagaaagcatctttgcaatttgaaaattcctagctgggccaggtgtggtggctcacacctgtaatcccagcactttgggaggcggaggcaggctgattacttaaggtcgggagttcgagaccagcctgggcaacatggtgaaaccctgtctctactaaaaatacaaaaaattagctgggtatggtggtgtgcacctgtaatcccagctacttaggaggctgaggcaggagaactgcttgaacctgggaagtcgaagctgcagtgagccgagattgtgcctggcaacagagcaagactccatctaaaaaaaaaaaaaatcctggctcacaggtgggatccagaacctgcagctgaagcttcaaatcctgcctgaatcacatcaagaacatatagtgcaacttcagagaagatcacctgaggtggaaacacacagcttagagatgaagaaacttcccagcatgtgtagaaacgtgaacacacacagcggatttgaagcctctacaaggagatggccaaagacatcagcaaagaattggagaggaccacttccttctgtcagaagaagattatcggccgggcgcggtggctcatgtctgtaatcccagcacgctgggaggccgaggtgggcggaccacgaggtcaggagatggagaccatcctggctaacacagtgaaaccccatctctactgaaaaatacaaaaactgagccgggcgcggtggcgggcgcctgtagtcccagatactcgggaggctgaggcaggagaatggcgtgaacctgggaggcggagcttgcagtgagccgagatcgcgccactgcactcactccagcctgggcgacagcgagactctgtctaaaaaaaaaaaaaaaaaaaaaaaagaagaagaagattatcatctgtgaggaaagagctcaggaaagctggagggcagttctgtccactgagagaaagctccaggagctaagaaaagaagatgattgtagtaggccaatcctggctgacgtggacttcaagttccaggctttccctgggggatcctttgctcctgcttctccaggcacagcccacagaggcccagaagtagcaggggtcccctgggtcatcaggtccccagcaaggaggagggaggtgctgtgaggctcagggacccaggccaccaggtttcactcaactctcccagaagtagggccctgaatgcgcgggaccacagagggacacagcagcctgggctgtctctttaaagtgatctggatttatctctttttagtttagctattgttacttgggatgccacgattttgatttcttgaagtttggtatagcattataattttacgttagtattttaaaatatagacatcaatgtaattctcataaatataattcctcatcactggaccctttaaattacatggtatgagtattgcatttttatttaagttcaccttttatgtttgagatgggtggagatgtttaaaacgataaagttcatttctgaatgccacaagctgttactgtacatctatacaagtaacagtatttacctgaataaattttaattgtttttaaaaacaatgcaaaaaaacttaagaacaatataacattcaaactatctaatatttgtattagtttagtcctaaatttattgactaacctgggagagttgatattttataactatttgtttcttgttttatatttttcttaaccattgatgttttaagacaatgttgtctaaacatttctaaactatataatcaacaaaaagatttccattgatggcaaacccattctctgttacacacatacacacacacacacacacacacacacacacacacacacacaaaacacccgaatgttgagagaagggactttcagttgttatgtcagtacctgaagaaaatgtagaattaagagagatacaaagtgtttttttaatatttacataaataaaggaaaaactttgtatgtacacaatttgtacacacagaaaagacaactaaattatctatacactaaaggagagttgcctgatgaatcagacaagatttcaacaagaaacagttcattccaaatggtgcagatgaagagactttgataaaggaaagtttcctgggctgtcacagtttcgtatgacagtttcctgggcggagataaaggcttggacaagagatggtgagactcccaggggctagcactagagaaaaggtagtcttacctctggacctaaaaggaggaggatgtggtgtcatctgagcccagtgaagaactgtcttgggacctgaagaaactagagctagaggtgcctactaaggtggccacggcgcattgctggagctgtgccccatgctccaactgtctctgcagccggctggggagggtgggaacatcaaggaaggctctctggaggaggtggtccctgagcttaacactgatgaatgagtaggagctacctccaatgcttttcacacatgaaggggtagatgaatcacttggagatctttcactaagcaggttcagattatcaggtcttgcagcaggagctgagaccccgggttgctcccaggtgatgcctacagcaggatgagatgtggaacagcaagaatccttcgataaatacagggcaggatccggggaagttgaagggacaggagcatttcctgcagacagtacagcccaggcaaagacacaagggcacagacagcctggtctgcgtgagctgcaccatgtgactggggttctgcagcccaacatcaggcaggaaggacaggaccatgagaaacagcgtgcaacatatgcagggtgtcttcccaattatcctcagaaacactcatctgcgtgggtgagtcttgtcctgaggataccacctgtcccagaaaagtgtgaggaaccgtaggctgaagctcccccttggagaagccaccatggagggtatgcttggcctccagaatcccctgtgtgggtcagcagctccctgctctcccggttgctcagcccagacatctggaaatccctcctgactcctctgtatccatccatcaggtactcccataaattccgccctgcaaagcccctctactcttttctgtccatctcgactaccaccatcctgtaagccaccattacctcttcccaagtgctctgttccttgggtaaccacctcccttactaggcccccacttcactattacttcctccaattcatgtctgcacacagccagagtggaccttttaccaaagacctgagcatgcttcatatgaagccagacctcggcctgcatgcggtgagtgtgcagcagcccttgaccttggtccttgtctcctacctcgggtcatgaacagcaaaggtgagcacacatccctgagtgccctggacgggcctggctggggccagcgtatcatgctgtgcccagtatattattcatagctccctttcactcttaaaattgcttcagttacgacaataaattatatgatcacagaatgaatgggtcacttgcattcaaacttttcaaagagaactgcaacattcctaaaatatagaagctcatgagaaaatagacaacatgagtcaaatcaaactctaaatacagccgtggacagtcaaagaaacgccactgctttgccaagttagcccatgtgggaacatcacgtttttggttaagacaattctatattcttaaaggccaaatgtaagccacctcagttttgggaaggtcccaataaaagctgaataatgtgtaagcatagtttaaagttaaggcccctctaatttattgtggacctgaagatattatgcttgaaaatcatttcacaggagtccattctaaagtttgtatgatgcaacgttcttgtgaattatagacaaatgattcatctgtttgactcagattcaaggacattttttgtggtgaagtaaggcactgagtctcaagatataatgtaaagatatggagttgctatgccaggaaaagaactatagaaagggcagctaggaagtcaatgcaatagtcagcacacctctggggccctccctgggagcctctgattccattactcttgggtgggccctggacatctatattttctccaagttccattcatgattctaatgctcagcaaagctggggaaccactgcaataaggcatgatcttgagagttatggcgcagagacatgcatctgcctctgactcagcacaaggggcaccccgcttctcacgtctcatgactgcatggtgtacagtgtggtcagttcagcctttatgtctaacctctgtccttctccaccctgtggggtgccgctgacctgtggggtgttgaccacaaacagattcctaccccatgtttcttgggggttcatcccatggggatttccagaaggagactggagtttcactctcctgcctcccctgatccctgctttttttttttttttttgagacagggtctcactctaacactcaggctggagtgccgtggtatgatctcggctgactagcaacctccacctcctgggttcaagcgattcttctgcttcagcttcccgagctgctgaactaaaggcacgtgccaccacgcctggctaatttttttatttttagtatattttagtagagacggaatttcaccgtgttggccagcctggtcttgaactcctgacctcaagtgatctgcccgccttggcctcctaaagtgctaagattccagacgtgagccaccgggctctcctgcctcccttttgaccagctggccttgagctggctgtgtccgtgggcctgaggctatgctcctctcaaaggctgactctccatggctctccttgtggttccactaactagtgcctacccttgtccctcgaggcttagaaggtgctgaagctgaactgcagggagccccaggttactgcctgtattcattacctgtgtctgctgtaagaaatttccacacactcattcacttaaaacaacatatatttattatcttacatttctagaggacaagagtccagaaatagtcccactgggctaacgtcaagggctagtgccctctggagctcctagagtcagcctgcattcccaggcttatggccccttccaccatcctgagagccagcagtgtggcaccttcaactctctctctgcccaccctccgctttcatcatcactcatctctgactgtgaggatcctgcttccctctttcgaggaaccctgtgactacatgggtgatccatgacagtctgcccatctccagatcctcagtcaccctgcaaagtctcttttgccgagtaaggcagcatgttcacaggttctggggagcaggaggtggacctcttgggggtcattattgcgtgtaccgcaccttgctttctactttgcagtttcctacgcccacacctttgtgaacagccccgtggtgtatgaaccctcctcaaagtcacctgtttccagcatcattttttccctaactctgtgcaccatctctagcacttattttttaaatgtattgaaaagatagactcaattagcacttatggaacagctttccgaggaaatgaatagatttgagcagtttgctgatagaggtgcccagtggaaatatcaaagtacaaatgagaatgttggtggtttccatgaagtgaagctgtctgaccagacaataacatgagaatcatgtctccacagagattacccacttttgaatcactctgtcaaggtgttggcacaatgctgccctcattatcgaaaggcgatgactacaacagtcttgttcattcaagagctgtactccagtcaaggaactgagaacctcccagggggcacagccttgtgcttggttgtgcaaccaacatgccttatttctaatttcacacacaatgtgtgtgatcagcaaaacaagggccccccaaatatgtctatgccctaatctctgaggcctgtgaatatgctgtgttacatggtcagagagactttgcagatgtaattaaatttagggactttataatagtgagattgtcctggattctctgggtgggccaaattaatttcatgaggccttcacagtagggcactctcaggctgggagcagaagaggggtgcagcaggaagagaagtcagtggagtctgatcctgagatggatggcatgcacgctcactggccctgagatgcaggggccacatgtgaggaccagagggagatctctaggggctctgacggctcctcccagctgacagccagcaaggaaacagggacctcagccccacaaccatggaaactactagcagtatagatgaacctggctgctgatttttcccagggcctcttagtaagaacccagctggttgacatcttggtttcaggcttacagaacccaaagcagagaaagcagttgagctgtcccagacttccgacctacagaactgtcaggcaataaaccgttattggtttcagcccctagctttgtgactgtttgtcatggcagcaacagaaaactaaacgaagccatttcagtgagagcaggaaaagtgctgtaaaatagtattctctaaaagagaaaattttcattgtttatttctgatgataaaaataatacactctcattcttggaaaatagaacaacatgaaaaaaaaagaagaaaattaaaattacttataatctcgccaaccagagatcattatcattattgcaatggactatatcatgttccctcaaaattcatatgttgaaattcccaaccaccaatgggactgtattaggaggtggggtctttatggaggtaattaaggtaactgaggccatgaaagtagggctctgatcgaataggattggtgtcctcataaaaagataatttaataattatatatattgtatatacacaatctctccctctctctctctttctctgctacgtgaggacacagcaaggggagagagcagctatctgcaagccgggaagaaagcccgcatcagaaacccaataggctggcaccttgatcttggacttccagcctccagaactgagagaaataaatgtccgttgtttaggccactcagtctatagtatttacttatggcagcccaagcatactaatacaattactgatcgcattttcctgtatttcttaccaatattttaaagcccacatttttcttagaagtaagaacatgtcatatataatcatatagcttcttaataagtaacattgttgccattaatatgttactagaaaaatttaaaaatctgtttttcaatgactacataatagtttttcaagctccataatggcaaggtctttccttttttaaaaaagtgaggtttaatttacatgcagtaaaatgaacagattgtaagggttcagtttgatcagtgtattagttcattgctgcactgctgtaaagaaatacctgagactgggtaatttgtaaagaaaagaggtttaattggctcatggttctgcaggctgtatagaaagcacgacagtctctggggaggcctcaggaaacttacaatcatgtcggaaggcaaagaggcagcagatgcatcttatgtggctggagcacaaggaatagagagagaggagagaggtgttgaacacttttaaacaaccagatcttgtgagaactccatcacaagaagagcatcaaaggaagaaactgctcccatgatccaatcacctcccaccaggcccccgctccaacattggggattacaattcgacatgagacttgggcaggggcacagatccaaaccatatcaatcagttctgacaaatgcattcagctatgtaactcacatcactatcaatatattagatgttttcgatcactctagaaaattccttctgtgccacttcctgatcaattcccaccattccagaaacaacttctattctcatttctatccccatgaattagttttccttgagaaggtcataaatgttatcatacactatgtacttttgtgtctgcttctctcactcggaataatgcttttgagattcatgcatgttgctgtgtattggtgctttggtcctgtctgttgctgagtcatgtatgggtacactgcaattttgttattggttcaccagttcatgaacgcttggcatatttctgttttggagctagtatgaataaagctgctatgaacatttttgtgcaaggatttttgtgggcatatgttttcatatctctaggaactgaattgtgagtcataggatagatatatatttaaaattataagaaacttccaaaccatttttcaaaatggttatatcattttatgtgctcaccagctacatgtaagagttccagtagttcggcttcctctgctatacttggaatggtcaatctttttcattttagccatgctagagggctgaagtcctatctcacttttaatatgcatttccctgatgactaacggtgttcatgtgcttattggtcacatatcctatttggtaaagtctctttttagtcttttacctaattttaactagggttgttttttttattattaaattctagcagattttaaaaatatatgcagatgctccctgatttgcaatggagatacatcctgataaacctgttgtaagtcaaaactatcatgagtttgcatttaacactccaataaagccatcataaagtcaaaaaatcataagaatggacgttttctcccagcctgcggcttgcctatttcatatcttaataatgtcttttgatgggcagaagtttttaattttggtgaattctcataatgcttggctgtgggttctcatccaaatctcatcttgaattataatttgaattgtaatccccacatgttgagggaaggacctagtgggacacgattggatcatgggggcagtttcccccatgctgttcccgtgatagtgagttctcacaagatctggttgtttaataagggtctggtgctacccccttctttctctttctctcctgccaccatgtaagatgtgccttgcttccccttcgcctttgtgaggcctctacagccatgcagaactgtgagtcagttaaacccctttctttacccagtcccaggtagtatctttatagcagtgtgaaaatggactaatacaaattccaattccaattttagtgaaatccaattccaaattttggtgaattccaaaaatttttttctatgactctgctaacaaatgtgtccatccccaaactcataaagatatttttaaagttttcttctagaggttttacaggtttagtgttatgataaggcctatggtccaccttggaataaattttttgtatggtatgaggtagggattgaggttcttccctctcctcatatggatttcacttatttctgcatctgtttttggaaatttcctttttttctcgttgaattgctttggcatctttgttgaaaataccatttgaccatatagttgggaacttatttctagaatttctattttgcttgatcgttttttgtctgttctttcagcagtacagtcctgtattagtctgttctcattctgctaataaagacatatgcaagactgggtaatttataaaggaaagaagtttaattgactcacagttccacatggctggggaggcctcacaatcattgtggaaggcaagagagcgtatgtaggagaactcaaaaccatcagatctcatgagacttattcactaccatgagaacagtatggggaaaccacccccatggttcaattatttccacctagctctgcctttgacacacgcagattattacaattcaaggtgcgatttgggtggggacacagccaaactatatcaagtactgttttgattactacagctttaggttaaaatttgaagtcaggtagtataagtcctccaaatttgttctttttcaaaattatttttgtcattctatgtgctttgaattttcatataaattttagaatctgctcattgatttctatttttaaaaaccatctgggatttggattgggattgccttgcatctatacataaatttggagataaatgacataataagaaaattgtctcccaatccataaacattgtatatatttccatttatttaggtcttattttatttctccacaacatcttatagtttttattacagaggtattacataccttttgttaaatttatctctaagtatttcatattttggggtgctattgtaaagagtattttaaaacttttatttttaaatgctatataaaaatatatgtgtatataaaaacacatacatgtgggtgtatttgtatatctatcactacagctatatgtttatattaatgtctatatctatgtctatctttgagtctctattttcagacttgggcaaactctactcctcaatttgtggaaaaatctcagtattgatctatgcatggtaggtgcatttcatacatatgtatgtatttttaacaatgtaagaagcaccctctatttcaccttccaaacaaaaacttaactgacagtaatctatatctaatcacatggtttccgccacttaaggcctatcccctggtctccatagtcaagtattatcatcccaaataaatctctgaatttattgaaccttttccctgttcacggattttgtggtgatgtttccaggtttttgctgtcacaactaattctgtaataagtatttttgtgtggtatatttggtccaaacactgattatattcttgggaggtgtttttataattggaattcccatgctaaagtacatcaaagggcatgaacattttaagattcttgatatagtttagcaaaagatttccagagtgcttgtatcaactaactctttcaccagcaagacaagaatggccacttcagagtacctttgccaaaatttattaaatttttttaacttcgttaaatataatgagtgacacttttaacttttgcattattcacattttattagacagtggtttttcctactctgcaaattttctattttgattttgaaatatttgtatttaatgatatttaatgtattgtggagagtaactagctgcacatcacatttatagaaagtatttttcccttttaattttgtacatgattataccaagttttatacatgctccatcctcatgacctaaacacctcccaaaaggcccaacaccccaacaaacagtgttacagtggggattaagcttccaatacatgaattctgggggacacattcagacaatagcaaatattaaaactataaattgtataaaattgtataaacacaatttacctattatctgttaggaagtgtcattgttctaaggtcatcctagtcctggtcagccagtctcacatgaaataaaatccacctggctgtgaagccacctccttcagcacagtgccatcatccctgccctctacttagtgaaaaacaatgggactgttaaagcgttgcattggaaagcattacctactcttccagcctgatctggaatagcctcagacgcccccagcccctctcagaatgaggggactttttccagctccgcaggactgtgcagggccccttcccagtgcagccttgactgtggggtgcggtccctctgcatgccactcacaggacaagtttaatcaagcccagtttaaggatcacaaccataatgtctacaaaaccatgatgaactacaaccatttgtagttcattagttcagaaaatcattactgaacttctgtgaacctccacagtgcaagagccctttttgaaatgcaaatttggatagattcccggttcaggcttacttatatgccaagataaatgaaaaggggattcttacatgtcagtcaaagatgatttctcatctagcacacaccctgagcttctggaagtcgcccagtcactcactacgttatttgccacacaggtattacacaaagaccacgagaaaaagtcatcgtccaaaccagagaaaggaaattgaccggtgacctgtcctgggcgcatagccgcatgtgatgacaggcaggaccctggcagggcagagaaaccagctctgttcagaggtttccagactgtaaatttaaagccctgtacaatttcaacaacaatgaaaatttaaggatcaagtgtactggcctttcagccttccactttgccaaataagcaaattgaaaaaatagttacactcatttttgctatcattttataaaaggatatttttaacagaaaaaaagggtaaagaaagttatcttagaataaaagacagtttctcaattaagttcatttgaagtatgacaacttgctatacattccttatttttctactttcgtttgcagaccagtgcaaaggcttttatatggaccaaccccagtcagaaagcaggcacttggaaacctcgtgtctgtgaagaacaaggggtggaacctctgaaatcctcccctttgagatttcccatgcattcacacatccttctgtgtgccttgaaaatgtaagaaacagatgtgggcaagaggcagccagaagactccggcacaggccctgcaacctatctgctcacatcctgcttgggagacatgtcagcgataaactccaggagtagtcacgagggctgacaggggttcctgcccggctctgcatccaacagcctggtggagcctaggctaagtctacaaaaatacggagctcagagctcctacctagatttctttgctttattcaggcagaattgacaaattaaaaggtatgtatttaaggtgtactacttgattatttgaaatacatgtacacaattatgctaattaacatatccatcgcctcacagttacctttttggtatgtgatgagaacactcaagatctgacctcttggcaaatttcgtgtacaacacagtattgttcattgcagtcaccacgcaggacactagatctccagaatttaagttacgttttgattgattaggtatgagttgggcctaacgatagcattttactctttttattcttttttcttttttttttttgagacagggtcttaactgtcacccaggctgagtgcagtggcacaatcatggttcactgcagtctcaactacctgggctcaagcaatctcctacctcagccccacaagtcggtgggactataggcacaccatcacgcttggctcatcttctatttctcatagagacagggtctaactatgttgccgaggctggccaggaactcctgtacacaagtggttctcccgccttgggctcccaaagtggtgggattacaggcttgagccactgcacctgactggacattttactctttatcacagcattagatacacatggtctaaaatatcacaaggcttataatggaaacaactagcccctggctctgcctaccccacgctgctcatagccatgagattacgaccaccagtgcacttagtgatgcttttgggaattcacttctatgcttgttaataacatgctcatagggctagatcctgatcctccattgagcacattaaccttggggatctgcaaaaccatggcttctccccactaaagatgtccatgtcctaatcctgggaacatgggatcctgtgaacatgtcactttccatgccagaagggactttgcaggtgtgattcaagtaagcatcttgagatggggagattttcctggattatccagcctggtccaatatcatcataagggtccacatgaaagggagggattatccagcctggtccaatataatcataaggatccatatgaaagggagggattattcagcctggtccaatatcatcataagcgtccatatgaaagggagggatgagagtggagtcagaaaaaagagaggtcgccgtggaagcagaggttggaacaattcactgtgaagacagaggaaggggccaaagccgaggaatgtggtggcctctggaagctggaaagggcaaggaagattctcctcagagcttccagaaagacaacagccctgccgacgcctttgattatagcacagtgaagactcatttcagacttctgaactccagaactgcaaggtcacagttgtgttgtcttaagccactgaatgtccggtaatgagttacagaagcaacaggaagccaatacagctctttaatactcccccaaattaccaccctgttgccccaacaaacattcgcttctctttcttcatcttcccaatgttgtttatctgggtcttcagaaagtcaatactatgattatgtaaatattttccactgagccacatcaagaaataagattgcatttctgtctcgtacatgtgtatgttttcaagcttataattactttggattttccccgatgcacctctggctaattttcaacagccacaatttacttgtaaaacgctttctcaattctattttccgcacagcttatatatcaaaaaaaaaattcagttcatgtttttcctggaggaatgcctccgggaaaccctggtctcccagcttccacctggactgatggctccctgggtcccctgcatggctgccagcctgacaatcccttctgtcctgctctgcttcactggtttcgctgctgagactcctctttcttggttttctcttatcttggacgagcatgtgcccagtaactgcctgagaaagggtgcagacaagaaacgtttcttgagatcttgagtgcttgaaaatgcctgtatttcattttcaaaattgatcagtagtttcataagccaagaattccacattagaaatttgttgcccttccagaattttgaaggcccttgtcttctagctccctgtgttgctgttgagaattctaagggcctcctgattgctgatatttgctaagtggcctctgtgttcctctagaagcttctaaggccttctctttatctctgctgcagtgatattccatgatgatttgccttggcctgagcatctatcaggagatttatgccacttagctctagggaattttcttgcattttaaaaaataacttattctctatatatttttttccttttctctcttttggaattcctgtttgtcaggagttcaactttcttctcttgtcttttcatctctcctctcctattgttggttcttcagccttttgcggtattttttttggcaaaaattctcattgttatcttctaatcctcctgtagaattttgtttcagctctgtcctctttcctgcccctaatcctggagctgtgaatgttcctgctaggagcctgatcttgaatcacaagtatacagctcctcttaagtcctagaaggttttaattgtgggtttgtccagaaagtttccctctgctccctgaattgcctgttttctctgagatcctttctgtcttgtctttagtttctgtttgtctgtgttagagggcttcctgtctggtgatccttggctatctattcatagttaagagtgagacactaaaatatttatcagaaactggtgtgctggggcaggatttgcctgtgcagtgagaggcgaagtacatgttcagaggagcccacattgttagcatctggagcctgtcctctgggtgatgttgtcctcagaggtcatctgttttcctgcttgctggttataggtttggctatggctgccctggagcagggatggggaaggggccagaagtccaccattcagtgtgcacaattcatatccccacctcaccctgcactggagtgccagctgcctcgatttcccagaggatcaccctcgagtctctcgtgggatcaaggagctagtgtctgcctgagcagcagatctaacaacccttggacagcattcaataacccacctcttgccaaccccatctcatcccaacctttcagagggcctggagtctgattccggagcctctcgggtggatcctcaaggtcttctgcctgcacctctgactgcagacactcggtagccagcttccttccctctgctaagtcaccgcccacccatggctgtgtctgctttcctcttcagacataactcacattgtcattcatcttatttaatccccagtcctgggctcctcatcctgtaaggttccctgttttcatgcttttactgacattttagggggggtgggcagaaaagtaatgaaagtacatgtaccaccggccatgtttaagcctcttctgcctgggctgggcatggttgttcacgcctgtaatcccagcactttgggagtccgaggtgagtggaccacctgaggtcaggagttcaagaccagcctggccaacatggtgaaaccccgtctctactaaaaaatacaaaaattagctgggagtggtgttgggcgcctttaatcccagctacttgggagcctgaggcatgaaaatcacttgaacccgggaggcagaggttgcagtgagccgagatcaggccactgtgctccagcctgggtgacaagagtgaaattccatcaccaaacaaacaaacaaacaaacaaacaaaaaagccccccaaaaaacaaagactcttctgcccatgcctgtcagatactgaaggaaaaacgcaaagcaccttccaggaaagctgagtcacagaggtgcacagagccaacccaggagcttctctttctcccacagcatgcacccatccctagcaagtcctgccagctctgctctaaacaggaccaggctcaaagctcatctcttcacctccttcactaccttccctaccattcgtctgggattcctgcaggcacctctgactagactgccctgctgtgtcctcttcagtctactctcagaaattagactcagctggagagattcctgttaaaacaaaagtcagataatatgaccccttcattctaaaccttccgacagcttcccatttcactcatgacaatatcctaaggccttaccatgaactgcagagtcaacacaatctttccatatcacctcctactcctggcctctttgcttaatctgcatcaggcacactgaaccccttgccatttctcacacacactgagtgtgttccagccccagggcctttgcacttgctgctcgatccccagatactcctatgatcatgtcttcacttacttccatgctcagctgaaatgttaccttatcagagagacctccattgttttatcaatccatttgcagcctgaaaaagtctgattgtgattcctgggttccaaacaccttgatccttcagctgctgatattacaatcagaaattaatactggttattggtattctgacttctatttggaatccatgaagatccctaggccaacacttctcaagctttaacgtgcatgtgaaccagaaagatgctagccagtgcttcttagacttttacatacaaaggaatcactttgagagcttgccaaatgcagattaagactcagcaagtttgggactagaccagaggtttgcatctgtaacacgcgcccaggtgatgttgagcctgctgctccccagcttaccttttgaacgacaaagtctagaccaaggtgaggatactgtccctctcatcccagacacacaagagaggctgggccttcatccctcccatccccacctgtgggcaagttactccatcagccagaagatggtcagctcttacagcctcagaggtctaatgatgcaacagctgcagcacctgctccctgggtgcccgcctgtggggtgagtcagcggctggactgagatgacagctcatgagcatgtctcctgggactgtgcctgtggcctgggcttgggccagactccgtcagcaactaaatgcacctggaaggctctcctcagctctgcaaatcccaccagctgcctgacctgctttccccaagccctaccactcctctcgcctactcttaactgccttcgtcaccccagttaggtcaaatggcattctcttcagaatgacctctaccatctgttgagactctgttatctgccaggcagtgttgcaggcatttcccttgcatcatttgatttaactctcataagtgtgctatgggatgactgttattaccttcttttaagatgaggaaatgacactgcagtgactataactaatttgctcaggatcacaaagctgggaagtgatggaggtgggatcccaggctggctctctgattccatcttgggcaggggacatcacatctgtgccaccaccctacttgtggtctaccaggctccaccacctccattatcttagtggacaggtggagaagcaccacctcatctttgtggagggaaatgctgtacttcagcttccttcatcctaacacccagggaaaaggaaacatcccagtcccatctcagctagctttcctgtattacctaatataagatgggataataactgagactcccaggtgaaggtcacagcccagggacacaggctcactaaaaacctgaaacctaatcattggactctatatagaatgattcgcctcccccatttctgcccagcacatccgcagtgctcttttgtagtaactggaacacaatataagctatatgtcagtgagcttgaagatatatgaatagaaacttctcaaactgaaagacaaagggaagaaagactgaaaaaaaaatggagcaccatgtttaaaaatggcaggacaattacaaaaggtgtaacatatatgtaatgggaataccaaaaaagaagaaagggagaaaggaacagaaaaaaatatttgaagtaataatgactgagaattttccaaaattaatgagacaccaaaccacagattcaggaaactaaagagaacaccaagcaggatggatattttaaaacgtatacctaggtatatagtatatattcaaattgcagaaaatcaaagatgcagagaaaataatgaaagaattcagaggtggaaaaaaaacctaccttacgtatggaggatcaagcataagactacatcagacttctcctcgaaaaccatgcaagtaaaaagagagtgtggagtgaaatatttaaagggctgaaagaaagaaaacaccactagctatagatagaattctgtatccagtgaaattatccttcaaaagtgaatggcaaatacttttgcagagaaagaaaaacggaaggggtttgctgccagtaggacttccttgaaaaagaagggaaaatgacataggtgaaaaactcaggtctactaaaaggaatgaagagcattcaagaagaaagaaacgaaggctaaaatgaataatttctttttcatattttatgctaatctaacagtttatcattttcttcaagataataatagtaaacatgtattgggtgattatagtttataaattagtgaaatgaatgacaaaaatgttataagagatgaggaaaagaattgtgaatactctgtgataacatattctcactacacatgaagtggtattgtgttatttgaaaatggacttggatcagttttaagtgtatattgcaaaatcacaggcaactactaaaaaaattgtaaagaagtataactgatatataatgaaagaggaaataaaatggaatcatataaaattctcaaggaaaatcagaaaaggagaaaaaagtgtaagaggaaaaagaaacagaacaagggaaacacatagaaacagtaataaatatggttgatattatatcaaatatattaataattagtttatatgtcaatgttctaaatatgtgaattacaagacagacgctagctgggtggattaaaaaaaccagacctaactgtatgttgtctacaagaaactcactttaactataaagacacaattagaatacaagtaaagagatagagatagatataccatgttaatgctggaatatctgtatttatatcagacaatgtggactacagaaaaagtatcagggcaaaggggcaagaagggcggagtgagcaagtggagccaggaggaattttagggcagtggaactcttctatgctttactgtaatcgtgcgtgcctgacattatgcatttgtcaaaactgctagaactgaacaacacatggagtgaaccctcacgtaaactatggactttcatggataataatgtaccagtactttcatccattttagcaaacgtactgcaacaatgcaaaatgctgataataataggggacactgtgggaggagtcaagggtctatgtaatatctctgcacaatttttctttaaacctatcactgctctaaaaaataaagcccagttttgttttgtttttaaaaaaagaggccgcgtgcagtgcctcatgcctgtaatcccaacgctttgggaggccaaggcaggaggattgcttgaggccaggagtttcagactagccttggcaacatggcgagatcctatctctaggaaaaaaaaaaaatagcttggcatggtggtgcatgcctgtggtcccagctactggggaggctgaagtagggggattgcttgagcccaggcatttgaggctccaatgagatatgataatgccactccactccagcctgggcaacagaacaagactctgtctcaaaaaaaagagagaaagaaagaaagagagagagaaggaaggaaggaaagaaggaaattatcacaactatcgcttcaggcgttggctgacctagacctccaccccggccctcaccacctggccagtcggagccttggtcctctacatccatggggcccctactgcctgagctaggcaatctctcaagaccccagggctggccttggcggacagttctctaatttcattctgggtaaagggaccatgagcgagttgctcatggcaaagtcccagaggatgaacaagaggctgtgagtctcggtctgccagagggattctaggagagagaagtagcttaataagcaaaaggtggcaaatatgagccgaaagaaggccccatccccttgtagtagacatgcacttctgaagacggctcagtggattggagactgttcccagggccaccttgggaggcatgagggaaggagcttgggtcaacctgtcatacccaaagcagagtcaccctcactcaggacacttgctgaacagggacaaaccagcttcatagaaaatccatgaaattgtagactccaccagaaattttagactccatctacttatttctcctggattgttacattgaaaatccaggtctctcagtttagacctttggggagactcttcagtcctctccccatctgctaaccttgaccaaacacaaaggagagaggggcttcagaggagggtccctcggaccttggtgggcaggacccactttccctgtgcagaaggaaacttgaaatcaggagactgagcctcacccagggacaggccccaccgctgtgccctgacaggcccttgtggacagaaagggacagggcgtagcctcacttcgaccctctgggtttgctgtggggccagctgggcctggtgtggctgagctccagagtgctgtcagccactcccagttccctcatgacctgggcagggaatataatatcacctctatctgtgcagtaagcacagcaatgtcagggacactgtttttagaacctggctggctcccctcccccagcccaactgattatctgtcctggttgccaggcacctgtttgcattagatacagaacactccgcagggtcccgagtaggcagttgtggcccacaggccactggcaaacagaggcagagccacagaggggctgctcgtccccaaatgtctctccagccgctctgaagctgctgcgggctgctgtgctggtgatggctgagatcatgagatgagccccgggggtccctgggcatccctgggaggtcctggtttgtgttgctgtggtggtcttagtcattaagagatgacactttataaagaggaaaagagcttagtaaaagtgttgttctcaccagcaggtccatggagaaggtggaacactggactaaagagacaggctgaggaagccctcaagtcacccctgatggaggccagaccttgaatgttacaatccctctgcttatcgacccttaataaaaatctgagcaggtcttctctgcaggacacaggaggctttctggaaaaaaaaacatggaaaagtgagtctcctaagcgttcccaagtgattgatgcaggacacatcttaaaaggatgaaaggaggatggaggaaaacttcagaaggaaataacacagtttgaatgaaaacacctattttgcagaaagtccggaagtgctcgaccaagagatcgtgagatgggagcagagagtacaggaaaggaaggaggagaaagaaaggctggaaacctttgaatgcacaaaaaaaacaggtcatgaaagataccacgagccaactaaaatctctggctgaaaatgtgctggacaccatgcagttggaagatttcactagggaccacagtgatgaggggaacttggaagcagagctaaagaggaaagcagaaaatgaagaaaccacccccttaaaaattaagtaaatttttttaaagttatgtgcatacattctgtatatacagaaaagatatctaaattgtatgcacgcagaaggagcattgcccccacaaggaacagttcatcctaaatggtgcagatgaagagactttgacaaaggaagtttcctgagctgtgggcagggatgagagctcagacaaatgatgggaagcctcccagatgccaaggtttcccacccccaggtttcaagggaggagagaggaagtgatgtcatctgagcccagtgaggccctgtcaagggaccagggaaaactgcccccactttttgctcccatcctctcattgactgcaggtgcacaggcagctgcctgaaagagggcctgcgaagtgcaagccagaggagttggcctccatggcacagagcaggcagaaaacaaatttggagaatgaccagcactcttgggtttatttgactgaaagtgcttgttttattgcattcactcacatccatttatttaataaatatccatggagtgtctatcatgtcttctgcactgttctaggggcttgggatacagagatgaaaaatgccaacccgatgaggcctgcagaccactagaacttacattttagtgatgggcaaggtcaggtaataaaagacaagcaagtgatgggaatatgtgctctgcagacatttccaatccagtgatgggagaacaggggctatgggagagcacccaggaggcaacatttaacctgagatctaaaagtaagaaggaggaccctaggagggtcaggggcagaatattgcaggtagaaggtacaggtaggataagaccaggagaactctgcctctgggtccaggggaagcaaagtaaagtggggttgtggggagtgtgcagagccctgtgcacagatgtgacatccagtgcagtgtgatcacccagggaagggtcttacccctcgagaggtggggttgcagggaagggggcatggaggaatgtgtatgccaccttgacctttttggttgtggagagaacggaataagaattgggggagaggcaggatttcagcgaggggtgtcacaggggtctgctgttggggtggtcatcacaagatgaatcaaggacagatcgggctgtgtttggatggttgtgaggatcagagaggaggaatgaaagacacccttgggtgctttcttataaccctgtgatgtttgtcactactttaagaaagccttagtaaaatctctgcaggagagcccctgacaaaaagtcagaaaggctgtagtgtattaattaccccagggaaagcctgcttttccctagcatagagtgtggtgtgccgcatgtctctcttgaacttgcatttggttcctgcactactcccacaacaaggacggtaggggcgggtacaggtggggctccagtgaagggtgggggttctcaggtatgatgcgtttacagcctgcattgaggctatatgatgcccctcgtttggagattccaagaggaattttaagtttattccaccagagtgcaccaccattaaataagaaagactcatgagctataagtgctcatgaatgtggtgggtgtacatgctggggctgtgcctcgctctttaattgtcccagcagccggctgtggtgggtaggaagatcagggcgggctctctggaggaggcggctcctgagctgaacactgaaggatgagtaggagctatctccagtgcttttcaaaattgaaggggcagatgaatcacttggagagcttgttagtaagcagattctgattcatcaggcaggggcctgagccttgctttgctcccaggtgatgcctatgctgatgagatacgaaagagggaggctctttagatcattatagggcaggagtcaaggaaagatgaagggacagggaaggaaagatgaagggacagggaaggaaagatttctggccaggacaaggcacaggcaaagacacgagggtgcacacagcttggtctaggggaacaggagagtttgtgttctggatccagggactcaggagggagggcaggacctggcagcagaacagatctccaacccacacagatgggctcttcctgctcatcctctccaatgcccctatctaccatgggtgatctttagcctcagaacactttatttttctgaggagtacaaaggatcacagactggaagtcacactggggaagcagccatggagaacgcactctgcctaaacacagcttgtacaaggaatagcctgaagacaaggtcaaaggcttcaaatcatgaaccaactcacgagctccggacaagctcatttgtcccatgagcaggatgtctgagggctcagtgaatcttagtgaacacatcaaatacaaatacaccttatgtctaagaatctgatgacaaatgagtatttttatcctctttggggtaaaataatgtgtattctgctgtgttcttgactgaagaggtatacatatacatataattatatatacatatgtatacatacacacatatatataattgtgtgtgtgtataggcacattacacaatgcaacacaacacctatatgcttttttatttcattctacaaatatcctcagtgaactccaaccaccacacgaggtacaaggttcaagaaaagatgctacataggttgcatgtactttttcaagggttcgaacacgctacttagacttctattttttcatttattcattcaacagagatttattaagccccttctatgtgccaggcaccaggcagatttgggagatactactgtgaacaagacagacaaggtcctggcttcaaagagctgaacttgactgagaggcgggtggtgactgaggcctggcggatgcagcggctccctgccaagatccctctccagttcagtttcccaggagccagggagggagctcgcctgctgcacagcatcgtcagggaaacttgtaattacagcatttattaggacagattagagagccaaaagaatcacattgttaaaggaacaatgaaattaaaaaagaggttaagcaaaaaccacaggagaaaaacccatgcattcgccagctattacaggctcacaagatagcagttacatgattgaaatctcctccttagcctctgatctgcttaggcatttttagctggaagagaccaatcatatctctagtcttgagcctggggccgtcttctccggctgtgggtacagttgggaggcagctttgcagaggccaagggccgtggtttgaccttgggcaaatgacttaatctccaggagcctcagtttacttatctgtaataattcctgccttgcaggctggccatacggccatacgactgagaaatcataagtgtgttgcgaccagcacatacattctcaaagagaggtaactgccagtcagtggtagaccaagccatgttagagcctgcagcaaaaggcaagttcagaaatacagatcctctttatttaaaatgttgttattttgtcatcaaggaatttattgcattaattttgattatatatatagcattaaaacagtatctatcttggctgggcgaggtggctcaggcctttaatcccaacactttgggaagccaacgcaggaggattgcttgcagccgggaattcaagaccaacataggggctctcatagtcccctcctcccccatgagatagtcatcatcatcctcattttacaggtgaggacatggaggcaccgagacattaagtaacttgaagaccacacagctaagcagccagagttccaatccaggctacagaaggtcagagcctgtgttcttaaccaccaggaaacacatggctttagacttttaccacagacacgtgcgcccaatatgcaaaccagccgacccacaaaaactgctttgcatttttaagcagttgcattgaagcttacagagtgttccagtgcgctaggagccccactgacccatcccgggctggccaggtgggctcttctcataactgtgtgtctgcggcatctgaccctgcttgtatcttctcctggaggactttgagataagacttcatctggggacactgagagtccaatgaatggagacactaggacacccccgactggaaaagacagacggatgtgcacactgtcaccctctacctccttccaccacagacccaaggtggcacacaggaaggtgcacactgcaccaaaaaacagaaaactggaaatgtgaatgcacaaggggtcggggacaagaggacccaggaggaggctgggccaagagggggttagaaagtaccctgtgggccataggacttcaacagttcacacagttgagtccctaactgaggccaagctgtatgggccaagaacaagggaaacaagatcagggctgaagcatgccccttccttgggagaaacacatgtgcttagggcttggctttaaaagagattttccttgtgaaatccactcaggggcccctgaggaatgtcatggactgggtcttgatgtgactctttcttatgccactgcatatgacaagcactgcagcttccgaggcccccatggggaaagccctgagagagggatggaggctcccccatggctcccagcacatggaccctacctcctgggacacatttctggtctgtctaatgtgatggtgtcgcctctctgtgctgttcacctgctccaccccaagggtaggccctggttcctgtgcattttgcactcctcccagcaacacaaaccagtgccacaaaggccctctgttgaacttgcagggtgcaaccgggctcctcagtggttgggaagaccctgcactgctgctctgacccccctctgtctacatggagggacatgttggggtccatggagaagtcaccaggtgatcaagatctgacctcccccatcccatgttcttccgtgggaggattaatcactgcctctctctagctcccctttcttagctaatctggagtcataaaacatcttagtattaggccacatccacacaagcagcaggtaagttcccttttacatatagcctctcccaggtattctgacgtgggcgtctcccccaccccagcctactcacagatttcagcatccaccctgagggtgtctgtgtgaagagcctgtctcctccttggccatccagggcctagctgctgtccagttattgctggaaccctcatcagtctggttgagtcacaaggaaaagatgttctgccccaggcactggtctggggaccacacattctccttctaaggttgtaacatggcagactcttcaccttccaccccaaccagtgtgtcaatcaaaggacagggccacacaggcaaggtagatcacagcagccagttattaggaaagaggactgaggttataatctcacaggccactcccacctggaagatggtggccttgttttcagggtcaggcatagtttaccaaaagacatttggaaaagggccttgttatttatagtttttaagctgtgcaagtgaagacaccaggaagagagcgctagggtcagagtgggttgagctggggttttcgctgttgttgttgttgttgccattactagaaaagagacaatgcaaaaacccaaggcattgcctcagagcccaggggtagggattctggactccctccacaatgttcaggtcattctaaagatgctgagagtccacgaggaatgagatgaaatgacagggccatgaatcaattcccgtggtgttgaaagcttcagggaggaaagctcctggctcacagctgggttttcttgggtcctcacagtaccgttgcgctggtctctgttgctacagcttcttggtggtggtgattgcagctccttggtggtggcagctgtgctctctgatcccaaaggaccactatggttccagaggaaagagtggttggagaacaagagcagttttcagcagaagcacttgtgactgagataagacacggaggagagctccatcctctaagcccaagtgagtagcggctcttggtgacagcaatgccaggccctacaccacttgcatttctattcactgagtgtctatggagggccaggcctggctctgtgctctacaagcccctcttggcattccttaattctctggggtttgtgtgtgatccctagtctatggttgagaagtaaatcagattcagaaagctggtgaggctagaacagggcttgaactcatgtttacagagaagcgaaccccagacccctttccctcttctctaatttgttcaatctttgtctctgtttgcctcccctctatcattctttatctttcctatttctctctcccttttctttccctcctctgtccctcttttctcttttttctcctttttttctcatttttctccttgctgttgtttgaatgtgtcctccaaagttcaagttttggaaactgaatccccagggtgcaagcgttaagaggtggggccttaataagtggtgatcaggtcatgaaaccctgccctcatgaatggattaatgtcattattgagggagcaggttagttattgtgagcgtggaattgttataaaagcaagttcagccctcacgctctggctctcccaagctctcttctgccttctgccatgggatgagtagcaagaagccctcaccagatgcagccccttgaccttggacttccaagcctccagaaccataagaaataaaatttttttctttataaatgacccagtctgtgatattctattataacacaagatgctcttcccacctcaatcaactttcactgcccaacccagttgcacatagactgagtatcagttgcacatagactgagtacgttgctgggtcctggtcacatggtgatgcctgaatattctccctgacctgaagcctttgcaaatctgcttactaaactccatgaaaactgtgctcagggtttttcattgaaaaattcaggtgaggtgaatattttactcatctcttttcggttggttttaacttttatgtaacatttaattaattctttcaaatgaactctgtgaatacctaattcagggagagaagcttcaaaggagataggaacatgctgggagacagaggatgtactgggggtagggaggaaagggaaaggaaacggaaacaaaggaaaagggaagggaagaaaatttagcattccccagcatgactcaaggttttcctggtagttcctataatctttcaggaaagtagagccttcttcagtgagaaatctttccctaatattgaagtcaactttgaatttaaatcctttctgagccactgactatttactgacagtccttctgacctttaactgtgagctaagattttccatttgaaagactaatgagggatttattcctaggatacaaagatggtttcacataattaaatcaataaatgtgatacaccacattaaaagaaagacagacaaaaaccatgtgatcatctcaagagataaagaaaagtcaccggacaaatttccacatttttcatggtaaaaagtcccaataggtgagagatagaaggagtgtacctcaatacaataaaggctacatataaaaagctcataactaacgtcacactctacagtgaaaagttgggatcttttcctctaagatcagaaaaagacaaggatgcctactcttaccacttctattaaacatagttctggatgttctagccagagcaactagaagagaaataaataaaagtcatttgaattggaaaggaaaaagttacattgtctctatttgcagacaacatgatctcatatataaaatatcctaaagactctaccaaagaactgttagaactaatacatttaataatgttacaggatacaaaatcaatatgcaaaaatcagtagcatttctatataagaacaattaactatctgaaaaagaaatcaagaaaacaatcccatttacagtggcgcctccccccaaaattacttagatgtaaatttaaccaagttaatgaaagatctgtagactgaaaactataaaacatgaatgaaagaagttaaaaaaagacacaaataaatagaaagatattctgtgtttaagaattggaagatttaaggccaggcatgacggctcaggcctataatcccagcactttgggaagccaaggcaggtgttacacgaggtcaggagttcaagaccagcctggccaacatggtgaaacccagtctttactaaaaatacaaaaaattagcctgctgtggtggcaggcgcctgtaatcccaggtactcaggaggctgaggcagagaatttgcttgaacccaggaggaggaggttgcagtgagccaagatcatgccactacactccaaccttggcgacagagtgagactccgactcaaaaaaaaaaaaaaaagaattggaagatttaatattgttaaaatgtccatactgtccaaagtgatccaagagtcaaatacaatcctatcaaaattccaatgactttttttagcagaaatggaaaaaacaatccataaatttggttggaaccacaaaagacccatgaatggccaaataaatcttgagcaaaaagaacaaagctagaggcatcacactacctgattttaaaatctattacaaagctatagtaatctaaacagcataaaactgccacaaaacagacacagacaagtggagctgaataaacagcccagaaattaattcatgaatttatggtcaattgagctttgacaaagattccaagaacatacaatagggaaaggacagttcttcagtaaatggtgctgagaacattggatatccagatgcaaataaataaaattagaccctcgtctcacaccacacacaaaaatccactcaaagtagataagcgacttaaatataagacctagaaccttataaatactggaagaaaacatggagaaaaagctctaggacattggtcttggcaatgaatttgtggatatgaccctaaaagcacaagcaacaaaagtaaaaatgcagccgggcgcggtggctcacgcctgtaatcccagcactttgggaggccgaggcgggaggatcacgaggtcaggagctcaagaccagcctgacctacatggtgaaactccatctctactaaaaatacaaaaattagctgggcatgctggtgggcacctgtaatcccagctactcaggaggctgaagcaggagaatccttgaacccggaagtgggagtttgcagtgagccaagatcgtgccactgcactccagcctgggtgacagagcaagacaccatctcaaaataaataaataaataaataaataaattcgcacaaatagaattcaatcaaaccaaaaaagctcccacacggcaaaggaaatgaccatagagtgaagaaacaacatatagtatgggagaatatatttacaaatcacacatctgataagaagttaatatcaaaaatatgcaggaaactcaaacaactcaatagcaaaaacaaaaacaagcaaaaacaaatataaatcagttaaaatgggcaaagaatctgaataaatatttctcaaaaaagacatacgagtggccaatgggtatatgaaaagatattcaacatcactaatcagagaaatgcaattaatatcacaataagatattaatatcacttcacatctgttaaaatgactagtatcaaaaagatgaaagataacagatgttggcaaggctgtgtagaaaatggaacccttgtacactgttggtggggatgtagattaatacagccattatggaaaacagtatggagatttcttaaggaattaaaaatagaactaccatatgatccagcaatttaatttctgggcatatatttaaaggaaataaaaccggtagcttgaagagatatctatactttcatgttcattgcagcattattcacaacagccaagatatggaatcaacttaagtatccattaatgcatgaatggataaagaaaatactattcaacctttaaattagccctcatgctaatttatttagaaaaatttatttcttatggttctggaggctgggaagtccaaggtgaaggggctgcatctggtgagggcctttttgctacgcatcccatggcagaaggcagaaggacaaggtagcttgagagagcaagagtgtgagggctctttaaaagaagtaaattctgtcatttgtgacaacatggctgaagctggagggcattaggctaagtgaaataagccagacacagaaggataaatactgcataatctcacttatatgtggaatctaaaaaagtagggctcatagaaacaaggcatagaatggtggctaccagagggtagaggttggaggattgaggagatggtggtcaacggacacaaaattccagttaaacaggaggaataagttcaagagatctattatacataattagactacagttaataataatatactatacattggaaaatttctagaaaggcagttttaagtgttctcactccaaaaataagtatatgaggtaatgcatatgttaaaaagcttgatttagccattccaaaatgtacacaaatatcaaaacatcatgttgtacaccataaatatttacaatttttacttttcaatttgaaaaaaaaagaaaaatgaagaaagaaaacttcttgttggattgagttctctatcatcaacagggatggagaggttttagggaaagagaaaatatcacctctctcactgtaagaaacagattttattattactaacctagaacactgcattttctctttgttgttgggaaatttctgatgacacctttaaaaaaacctgagatttgtctctgggtaagttaaatgttcattaagtgatcacagaaagtaaaagtttgggaaactttaccaggagcgtttgggggaagcaaaccctgcgcagatttcctttgttcttgcaatagcagttccctcttgagtgtgacttggggcccctcagttggccctgggacatctgctcgctttgggactctttgtgaacattacttggggaaggaagcactgggggaaggaagcactgggcttgggacagggttgggcgctgcctcttcactggaccatgacaaggttgttacctcaccaaggagaggtgcaaaaagcttaggggcttggatttctagatttcagtgccaactatgccacttactggctttatccttggggaatttatctactctgtgaccctcagtttttttatcttaattattaatacatacctcataatgtgactgtgaggattcacttaataatatatggaaaaccatagaatagtgcccagcatctaggaagtgccacagcccccttcagcagctagtgaaacctgcagaccacttttcagagtgatattattatttttttctaggtttactgagttataattgaaaaaataaaaatggaatatagatgtacaacatgaagctctgatgcatatatccattgtgaaatgatgaccacaatcaagctaattaatgttatctatcacttctcatagttcaacctttttttgtggtgagagtactgaagatctactctcttagcaattttcaaatctaaaatacattattattaacacagtcactgtgccgtacgttagctctgaggaccttattcattttatacctaaaagtctgtatcctttaaccaacatctcctaatttcccactgtcatctctactgccacctctggtaaccagccttctgctctgtttctgagtccaaccttcttagattccacatatgagtgagatcatgctgtgcagtgtttgtttttctgtgtctggcttgctttcacttagcataatgtcctccaggtccacccatgttgttgcaaatggcagaatcttcttcttgttaaagactgagtaatatccctgtgtgtgcgtgcatgtgtgtgtgtgtttgtgtgtgtgtgtgtgtatcacattttcttcatccattcatccatcaatggacactaagcactaaggttgattccgtatcttggctattgtgaataatgctgcaataaacatatgagtccagatacctcttcaagatactgatttcatttcctttaaatatatgcccagaagtgggattgctggatcatatggtagttctatatttagtatcttgaggaatttccatactgtttttcataatgattgcagcaatctatattcccatcaacagtgtacaagggttccattttctacatggccttaccaacgtttgttatcacttatctttttgataatagatattctagcaggtgtgaggtggtatctcattgtggttttaatttgcattttcctgatgattagtggtgtagagcatcttttcatatacccattggtaattcgtatatcttcctttgagaaatatttattcagatcttttgcccattgttagctgagttatatgtgagttggttttggtttgttgttgttttttgtttttgctattgagctgagttccttgtatattttggatattaaatccttctcagctgtatggttgacagatacattcttgcattctgtaagttgcatctgtaggttgcaacagagtctctttactctgttgattgcttgctttactgtgtgaaagcttttttagcttgatgtaattgtgtttgtctatttttgcttttgttgcttgtacttttagtgtcatatccaaaaagttattgcccagaccagtgtcatcccctatgttttcttctagtaattttaaagtttcaggtcttatgtttatgtctttaatccattttgagttaatttttgtgtagggtttaagataagaatccaattttatttttattttttgtatatggatatccaatttccccaacaccatttattgaaaattctatcctttctttgttgtgtattaacatcagaataatatttttaaatacataaaattcagaagatgacaaaggaaaccaattacattgaaatgcatacagagttataattctgaaagagcaatatatgtgcctctttgtaaacacatcatatatcaaactgcagtgaccgttctaacaactattgcaatttcaaaatcatgttgagtaggaggagtactttgagattctgaaacaacgttcttgtgctatgaaatatccatgattttgattggtgatggtatcccaggttttgttaatgctgctgtaatctgttgcttccattccatagttgaataaaatgcttgatatctgttggaaattagtaaaaataaaaacgtatttttttccatccaagttcattctcagaccctgaagagtcacttctctggattctgcagcaaagttcccagctggggcagcaagatttaggcaattgaaaagaacatacaccttgttctcagtggcaaaccacatggaaagctttaaatgtcagagaagaattctgccattttgctgacttttttgtagttctcctaataaacaagtgttaagtgacaagcttttcagaggagataattttcttccaagtggtctttttatttacctgaatattaagttcaaagatactctagtctctcaaaggaaacctgtgggtggagtgttttttaaaatgtcaaattccaaacgaagctgaagggcacagcctcaagaaggctctgtgttcaccagtgcacagggacgtgtcagccctttattgccattgtctacataacatttttcaagttctctgagttgtgaggctgtcagtatgaagactcctattttttctgctattaaatttttttttcctccaactttttctttttctttttcttttcttttgagatacaatctcgctctgtcacccaggatactggaatgcaatgcagccttgaactcccaggctcaaacaatcctcctgcatcagcctccaaagtagctgggactacaggcatgcactgtggtgtggtttgtctctgtgtccccacccaaatctcatgttgcattgtaattcccagtgttaggggaagggcctggtgggaggtgattggatcatgggggcagatttctccgttgctattttcgagatagtgagtgagttctcatgagatctgatggtttaaaagtgtgtggcacttccccccaccccctctctcctgccaccttgtgaggaatgtccttgcttctccttcaccttctgtcatgattgtaagtttcctgaagcctctcagtcattctttcctgtacagcctatggaactgtgagttaattaaacctcttttcttcataaattacccagtctcaggaattcttcatagcagtgatgatgaatacacaccatcacacccagctaatttttctttatttttttagtagagatgtggtctcactatgttgcccaggctgttctcaaactcctgggctcaagtgacccgcctacctcggcctcccaaagtgctggtattacaggcgtgagctgccgcacccagccctcctccaactgctgctggttgctatcataggttctcactgggtgtccacctaacatgtcccttcaggaaggctggtgtcctgacattcggtagcggaggcctggtgttgagctcacctgcatttctgcccccttctctggctttctggggatgccctcctcaacctgaaaatgacttccaactcctcagcacagaggtgggcacgtgacccaagcaggtccaggattccataagatcccaaacacaaaggatcctgtaatcctggggctccagtggccgtctttttccttttggagaactaacctattgcagagaaagtagtagagctaaaagaaagagaaagaatcctgatagcatctgtgactctggatccagctatccataaagcgccatatgctaatgcgctcagttacccaagtcaatgagtccccttagaagcttaagccagtttgatctgagtttctgccactttcaggaggaagaatcttattggtatattttataataatccggctgatatgcaaactgtcttcaatagaatgctctgtccagagtcacagtggagtccatcgcaacaaataaggtcagacagctcacagctacaactgggctcatgccttccaagtatcaaagtcataacaaacttcctctgtgtgagtccacaaggcattcttcctctgggggaatcactccctttccattgtcctgatactctctctctgtggggctgtagaggagtgcatggcttttgccctacttccaagccttctcagggaacacagcagggacaaagagctgaaggctcagccttggccatggcccatcaggcccactgcaggcttctcctgggagaagatccagagcctcgggctctgggctcccatatgcagggagaacctccgaccacagaaattggaaggagctaccactccctaggagacatcttcccttgagctttttcaagggctgaacaaacagagcccacacttgttcacggaatccatgggcctcagcacatcagagagaggagaagaaattgacccagagtgtaacccacccccaacttcgggccccaccaagaattgtcagtgatgccagaggaagaggcacctaattcaacagatcaatggagactcacatcacccacaagcaccacttatctgctatttcatcccacaccagtacctgatcatcaaccgttgcaaacactcattgctgtaattgtatcattagtttcaatcacagccaatttggggctggcatgtgaatatccttttctgttcccactgctgatgaaatttcagaattataaggtgaatgaaacctagtagattaaagtaattgtgaaactgatgctaaagaacagtcctgttccccatgccgcctaaacatgtaatttcagacatcaaacagaatctttaagctgaaataaaatctctacttagtctagcaccattgtattctctgtatgggatgaaggcagctcttaccccatctattaagatttattattaaaattgcctgggggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagatcgcgccactgcactccaacctgggcaacagcgagactccgtctcaaaaaaaaaataaaaaaataaaaaataaaataaaataaaattgcctgcgaattaaaaaaatacattttttcccttggcaaagtcagcacctagctatctcagttaactctctggaggagaaaaaggggaacagtggttgtgaaatttgagacttgcaagagtgcccaggactgcctaggcatagactagactgttccacctaaatactcccatagaaaatgccctaggtgaagtctccaggtgtagttttcagagcaaggccctcacccagttcttcaggttccataatacattagtgaccacactaaatcttaaagtccttgccatcagttgacataaaagtccagtgagaactctggccttaccagtgaagactaggccccaagaaagctgtgtgagctgttgtatgttgagtcagcctccagccagtcttctacccattgctagaataacaaatcaagtctcctccttcaactgggactcatgtgatcgtcaccctccttgaaagacagccctgtcctaaccccctccagagctgccacatccctggtccccaaacaatcaagtgaggagggaaggctactggccacccacaaggccctgaaagtacagcgtgttgactcaggaataatccaagcctatggcaggaggaacaggactttatggaagctgggagactgaagaaggagtcaccatggcaaccagctctccagctttcattctcctccccatcacttgatccagacattctccttccagatcataaggcctgacatccatccacttcctatcatgtggtcacaggcagatctctctacccactggcaaaaagtgggctgatggaaatgagcattgggtgcatggtgcttggactgggtttcatagttatcgctccaaaatccatggcctcttcggaacctcagaatgggaccttatttggaaaaagggtctttacagatgtaatgagttagtataacatcattctgaatcaaagtgggccctaaatccaatgactggtgtcctctataaggaaagaaaacagagacacagagacacacagggaagaagccatgtgaaggccaacgcagaggttggagggatggagcaacaagccgaggaatgccaaggactgcagcaaccaccaggagcttggaagaggcatagaagctactagaaggagccaatcctgccaactcctggatttcacatttctgatctccagaaccgtgagagaatacatttctggtgttttaagccaagctgtttgtggtgcttactaagccagccacaggaaacacacacagggccacatgaacacttcaaaatacagccattgcaaaacctcaaacctggaatctaattagcctgaaccagccattaaaagaaaaagtgatgtatgcctgataaccattctccatatttttataaggagacagaaccagtaagaaaaagaacatagataaattaattcccccgttttacaagatatttattttacaagtaaccttccagggaattccctggtatgaacaaatgcatgcattatgaacccatccaatgatattgagttcactgctggaatctgggcaaaacactgcaagttgctcggtgaaaacaggtccaattgtgtttggtttgctctaagtcagctgcagggaggcactgctctgccacaagacaggagggaggaaagctggggaaatcagataggtttccttgttgcaggtgtgttcaaaggagggttggagcatcttccactgacttcacctctatgaagctcctctcctgtcttcgtagtgagaacagagatggctgtaagtcaaacacgcccggaaaaggcattcgtagaccagaccatccatgcactgtgttaactgaccacttagggcgagcagcattacaggcctgtagttgtggaggcaggagctacagggacatttctgatgtggctccagccctccacgatggtatgatccagttgaacccagaatcccagcacatgtggaccagtcaggaagcaactgactgagagcggtagaggacccaaatttcttcggaggtatttacttcgttgagaaaacccacagggcagctccaatcccacatccctggcatcctgtggcttatgggcgtggggccacttgcctgttggaggcgtgatgcatgatccccagtatttgctctgcaaggccaggcatgggctcaccgagaaacaacctcgcctttgtgttgtcctcctcctggacaatccatgggacaggccagccctttggagggcacttcctgggctgtccatccctcactggggaagcaagaaggctctggattgcctgccccccagccacctgatatgagttgggcacagggagtgtcattagcctggggcattaatcccctctggtagatgtcccaacaaacatgcaccaatcagagacaggggcagggcaccaggggaaactgtagtctcctttgctttgaatcagttattatggaggactttatcacaaacacagaattacattcccaaatattcattcttttcaacacaaagcttaaaaggtattgcagtttgaattgtagttgagacatgactctgtagtacccactactgcataaggttcaagtccaaaatgatccacagtctttttcttctttaatattttctctttttcactgagatgtaacactgtaccttctattgtaggtgctccaatctcaggtataccatccaataatgtcttacatatgtctacagccatgcaactgcctcccagagcaacatctcagacatttccaggctccagcagacttcctgatgttccttctctttcaatacaaacctccagtcctacaggtaactgctattacaacttctagtaccatgtgttattgagcttcatatagatcggaattgtacaatgtgggctccttgagatctgctttcttctgcttaacgttatgtctgtaaaacatctttgcatggggcaacagtttattttttcattgctatgtactattccattgaatgcatatgccccaatttatttagttcatcctaacgtggatgggtatgtgttgttttctgtttgggactatgatatataaaggtgctaggacctttctcacacatgtctcttggtggccacagccctcgtttcttttgagaatatgcccaggagtttctggggcatggaaatatgtatgtttaactgtagtagacacctccaaactcttttccaaaactgaaccaatttacacttcaaccatcagtgtatgagagctcttgctgttacccaccattgtcaacacttgttgttgtcagtccttttaattttagcctttctaatggatgcataatggtatcttactgtgggtgtaatttgcattttcctcttggctgtaatactgggcatcttcttatgtgctattggccacttgtattttcctctattatgggggtctccgtgaatcactctataaagggcctgacagttaatatctctggctttggaggtcatatggtcttgtccctactactcaactatgctgttgtcaagcaaaagcagccatgggcaatgtgtgaatgaatgggattggctgtgttccaacacagcttatttataaaaacaggctgggatgggaggtggattttgctggtgaggctttaatttggtgacccctgctatattgtaatgtgcctgcccaagacttctgcccattttaaaattaggttgtctttttaatttattcatacaagttctctgtaagttctaaattccagttttatattcttaatcatttatcatgttttgaaaattaaaaaaaaaaaacagttattatgttggaccattcctatagcttttgccctgtgtttctaccatagtcccctaagagatgagatcactcttgtgaaaagagcttcctgctgttacccaagagagctgtctgctgccatctttgccccagcatgacagtgtggcagcccagcccagagcactgtggctctgcttgtagccttggggagtcccactgcctagaccaggctgggtgaaaatagcctgacttcttggaatggacacagttttcaaaaggagcataaatttagtctgccaattcatgtatatgccatgatggtcaaaattgagggatctgggcaaagattccttttccattcttagccaaatgctttctaggttgggcatcagttgatggtgcaattggaggaaattgcccaattattttgttgcttcactaacaaaatgcttactgtctttgcattgtaaaatctttttttcatttataagctccccaagggagcaaaagccatgcacagtggtgtgccaggagccctcatgattgttttgcctgttatcttatttgagcaaatattagtatctcattttgcagcaaggaaactgagggtcagagtagttacatgaattgatcgggatcaagagattaaataattgaccaagccagaaatgttttactccaaagtccatgatcttccccatgggcccatactgtggtttccctttcatatagagatggggctggaagggccattattgaatatctggtcaagttccctcacttgatggatgaacgctgagatctggaaggagtcaaccaactcatcacccaagattcccccaacaagctagcagcaaagctt

SEQ ID NO: 11 - DNA, 5047 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttcccaccgatgagaggagctgggtgtactccccgctccactatagcgcccaggcccccccggcctccgacggcgagagcgacacataatttctatgcagcccccgacccagagccgagctccacttctgctctggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcctggaaggcccctgctgtggagaagccggacccatccccgaggtccccagcgaggacacacactccacgagagcagcccctccactctgcccaggagaggggccgaccctcctcgggaaccggccacccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccctttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagc

SEQ ID NO: 12 - DNA, 1324 bp, Homo sapiens
ctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccctttt

SEQ ID NO: 13 - DNA, 1611 bp, Homo sapiens
atccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgggctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgccgggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagctggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcatgcactgagaggggaggtttccacacccctcccctgggccgctgaggccccgcgcacctgtgccttaatcttccctcccctgtgctgcccgagcacctcccccgcccctttactcctgagaactttgcagctgcccttccctccccgtttttcatggcctgctgaaatatgtgtgtgaagaattatttattttcgccaaagcacatgtaataaatgctgcagcccaaaaaaaaaaaaaaaaaaaaa

SEQ ID NO: 14 - DNA, 4724 bp, Homo sapiens
tgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 15 - DNA, 2337 bp, Homo sapiens
  misc_feature (61)..(2277): The "n" residues at positions 61 and 2277 are nucleotide "g" as shown in the corresponding sequence (REL gene) in the Entrez Human Genome Sequence Database.
cggaaggtgtgagccgcaaacccagcggagggcgggaagaaggaggaggcctctagggtgntcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggngctcacacctgtaatcctagcactttgggaggccaaggcgggtggatcacttgagaccag

SEQ ID NO: 16 - DNA, 4079 bp, Homo sapiens
ggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggttatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaaaaaaaaaaaa

SEQ ID NO: 17 - DNA, 3301 bp, Homo sapiens
  misc_feature (2966)..(2972): The "n" residues at positions 2966, 2967, 2968, 2969, 2970, 2971 and 2972 are nucleotides g, c, c, c, c, a, and g, respectively, in accordance with the corresponding sequence (PPARD gene) in the Entrez Human Genome Sequence Database.
gaattctgcggagcctgcgggacggcggcgggttggcccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcaatgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagctctcttcctgtctttgttgtctccctctttctcagttcctctttcttttctaattcctgttgctctgtttcttcctttctgtaggtttctctcttcccttctcccttctcccttgccctccctttctctctcctatccccacgtctgtcctcctttcttattctgtgagatgttttgtattatttcaccagcagcatagaacaggacctctgcttttgcacaccttttccccaggagcagaagagagtgggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtggcagaccccggcagtagagccgagatgcctccccaagactgtcattgcccctccgatcgtgaggccacccactgacccaatgatcctctccagcagcacacctcagccccactgacacccagtgtccttccatcttcacactggtttgccaggccaatgttgctgatggcccctccagcacacacacataagcactgaaatcactttacctgcaggcaccatgcacctcccttccctccctgaggcaggtgagaacccagagagaggggcctgcaggtgagcaggcagggctgggccaggtctccggggaggcaggggtcctgcaggtcctggtgggtcagcccagcacctcgcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctatgtgactctgggtggaagtgcccagcccctgcctgacggnnnnnnngatcactctctgctggcaggattcttcccgctccccacctacccagctgatgggggttggggtgcttctttcagccaaggctatgaagggacagctgctgggacccacctccccccttccccggccacatgccgcgtccctgcccccacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaaaaaaaaaagcggccgcgaattc

SEQ ID NO: 18 - DNA, 1740 bp, Homo sapiens
gaattccgggctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccaggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccaaaaaaaaaaaaaaaaaaaccggaatcccggccggaattc

SEQ ID NO: 19 - DNA, 2194 bp, Homo sapiens
tctctgtcctgccagcactgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggagcctatagcaaacccaccctctcagccctgcccagccctgtggtggcctcaggggggaatatgaccctccgatgtggctcacagaagagatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagtctgaccctccagtgtggctctgatgtcggctacgacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacggggtggagctggacagtcagagcccacacgatgaagacccccacgcagtgacgtatgccccggtgaaacactccagtcctaggagagaaatggcctctcctccttccccactgtctggggaattcctggacacaaaggacagacaggcagaagaggacagacagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaagcaggtcgtctcgttccaagatct

SEQ ID NO: 20 - DNA, 492 bp, Homo sapiens
  misc_feature (94)..(107): No nucleotide residue exists at positions 94 and 107 according to the corresponding sequence (FOXO3A gene) in the Entrez Human Genome Sequence Database.
  misc_feature (226)..(240): The "n" residues at positions 226, 227,228, 229, 230, 231, 232, 233, 234, 235, 236, 237, 238, 239, and 240 are a, t, g, g, c, a, c, a, a, t, t, g, t, t, and t, respectively, according to the corresponding sequence (FOXO3A gene) in the Entrez Human Genome
catgcattaacttgcggtatttttctgttaaaatgttaaccgtccttcccctagcaaatttaaaaacagaaagaaaatgttgtaccagttaccnattccgggttcgnagcatcacaagcttttgagcgcatggaactccataaactaacaaattacataaactaaagggggattttctttcttcttttgtttggtagaaaattatccttttctaaaaactgaacannnnnnnnnnnnnnngctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccac

SEQ ID NO: 21 - DNA, 616 bp, Homo sapiens
ataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaatgaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctg

SEQ ID NO: 22 - DNA, 870 bp, Homo sapiens
  misc_feature (2)..(64): Each "n" position in this sequence may either represent at least one nucleotide selected from a, g, t or c,  or contain no nucleotide.
  misc_feature (228)..(362): The "n" positions at 228, 271, 279 and 362 are c, c, t and c, respectively, according to the corresponding sequence (SLC17A7 gene) in the Entrez Human Genome Sequence Database.
  misc_feature (420)..(870): Each "n" position in this sequence may either represent at least one nucleotide selected from a, g, t or c,  or contain no nucleotide.
tnnnannnnnggggttctactcgcctgttccagtgttgtcanatcctctttccttcccaattgnctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggtttggaggnacccacaccccccgttttcctctatctccagggactctcaggntaaccttngagatcactcagctcccatctcctttcagaaaaattcaaggtcctcctctagaagtttcaaatctctcccaactctgttctgnatcttccagattggtttaccaattactcggccccggcattccagggattgattctcancagngtttctgatggaaaatgggggttcaagtccccgnttccgngcccanncanatttccccncccagnagatcantnggttacaggttganttgtnaannnnnnnnnnnnnnnnnnnnnnnnnnnnnnaannnnnnnnnnnnnnnnnnnnnntnnnnnannnnnnnnnnnnnnnnntnnnnnnnnnnnnnnnnnnnnnnncnnnnnnncnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnnnnnnnncnnnnnnnnnnnnnnnnnnncnnnnncnnnnnnnnnnnnnnnnnnnnntcn

SEQ ID NO: 23 - DNA, 1303 bp, Homo sapiens
atcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcattgcagcaaacctgtccttgctcctgtccagagcagagaggaaccggcgcctgcatggggactatgcataccacccgctgcaggagatgaacggggagctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaaggagccaccaggtggtgtgtggattctgaaaaaaaaaaaaaaaaaa

SEQ ID NO: 24 - DNA, 1989 bp, Homo sapiens
agccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgg

SEQ ID NO: 25 - DNA, 1633 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcctccgccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcct

SEQ ID NO: 26 - DNA, 1342 bp, Homo sapiens
cattcggggacgctctcagcgctctgctcacgacccagcttccttcaaaatatctgctgttcatgaaatcctgtgcaagctcagcttggagggtgatcactctacatccccaagtgcatttgggtcagtcaaagcctacaccaaatttgatgctgagcaggatgctttgaacattgaaatggccatcaagaccaaaggtgtggatgagatcaccactgtcaacattttgactaaccacagcaatgcacagagacaggatattgccttcacctaccagagaaggaccaaaaaggaacttgtatcagcacttaagtcagccttatctggccacctagatagtggctttgggcctattaaagacacctgctcagtatgatgcttctgagctaaaatcttccatgaaggggctgggaaccaacaaggactccctcattgagatcatctgctcaagaaccaaccaagagctgcaggaaattaacagagtctacaaggaaatgtacaagactgatctggagaaggacattatttcggacacatctggtgacttctgcaagctgatggttgccctggcaaagggtagaagagcagaggatggctctgtcattgattatgaactgattgaccaagatgcccgggatctctatgacgctggggtgaagaggaaaggaactgaagttcccaagtggatcagcgtcatgaccgagcggagcatgtcccacttccagaaagtatttgataggtacaagagctacagtccttatgacatgttggagagcatcaagaaagaggttaaaggagacctggaaaattctttcctgaacctggtccagtgtattcagaacaagcccctgtatttcgctgaccggctgtacgactccataatgggcatggggactcaagataaggtcctgatcagaatcatggtctcccacaatgaagtggacatgttgaaaattaggtctgaattcaagagaaagtatagcaagtccctgtactactatatccagcaagacactaagggtgctgtacctgtgtggtggagatggctgaagtccgacacagcacgagcgtccagaaatggtgctccccatgcttccagctaacaggtctagaaaacccgcttgtgactagcagtccctgtggctgttcctgtgaggatgacgttagcattacccccaacctcattttagttgcctaagcattgcctggctttcctgtctagtctctcctgtaagccaaagaaatgaacattccaaggaattggaagtgaagtctatgatgtaaacactttgcctcctgtgtactgtgtcataaacggattaataaactgaatttgtacttt

SEQ ID NO: 27 - DNA, 3194 bp, Homo sapiens
aagcttgctgagagtggctgcagtctcgctgctggatgtgcacatggtggtcattccctctgctcacaggggcaggggtccccccttactggactcaggttgccccctgctccaggtcctgggtgggagcccatgtgaactgtcagtggggcaggtctgtgagagctcccctcacactcaagtctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagtacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatggtaagtgagagaatgtgggcctgtgcctaggccacccagctggcccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccacgctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgcctacggcagggcctccagcaggaatgtcttaatctagggggtggggtcgacatggggagagatctatggctgtggctgttcaggaccccagggggtttctgtgccaacagttatgtaatgattagccctccagagaggaggcagacagcccatttcatcccaaggagtcagagccacagagcgctgaagcccacagtgctccccagcaggagctgctcctatcctggtcattattgtcattacggttaatgaggtcagaggtgagggcaaacccaaggaaacttggggcctgcccaaggcccagaggaagtgcccaggcccaagtgccaccttctggcaggactttcctctggccccacatggggtgcttgaattgcagaggatcaaggaagggaggctacttggaatggacaaggacctcaggcactccttctgcgggaagggagcaaagtttgtggccttgactccactccttctgggtgcccagagacgacctcagcccagctgccctgctctgccctgggaccaaaaaggcaggcgtttgactgcccagaaggccaacctcaggctggcacttaagtcaggcccttgactctggctgccactggcagagctatgcactccttggggaacacgtgggtggcagcagcgtcacctgacccaggtcagtgggtgtgtcctggagtgggcctcctggcctctgagttctaagaggcagtagagaaacatgctggtgcttccttcccccacgttacccacttgcctggactcaagtgttttttatttttctttttttaaaggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttctacttgtccagtgttctagtttgtttttaaccatgagcaaatgccagtgggtgcctgccttcccatgaggcaggggagggaggaaacggggaggtggagagggggcgggggcctcccaggcgttgggcactatccaagggccaacactgtcagagcagaggggaggtgagagccgggcatagtcggaattc

SEQ ID NO: 28 - DNA, 4249 bp, Homo sapiens
gggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaacctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgatggatgataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattc

SEQ ID NO: 29 - DNA, 531 bp, Homo sapiens
  misc_feature (183)..(467): The "n" residues at positions 183, 426, 431, 449 and 460 are g, g, g, t and c, respectively, in accordance with the corresponding sequence (PARVB gene) in the Entrez Human Sequence Database.  No nucleotide exists at the "n" positions 186 and 467 according to
ttttttttcaaactgcaaaacccgttttatttttaataaaaggcctcacttccaaggagagcccagcccaggagatccccggtgaatcgtcaagcctgggtcctcggggagccggcgttcctgctgagctgatgttgtacttctgaaggcctgtgatcgctaactgcaccatgaggcagaatncangggtgctctcaaccagctgggggttggggttcaggctttttttcatctttcggccaaggcagacaacaacggactcatcatcccacgcgactgagtgacgcgaggcttcaaacgcaagcacgagtgtttagaatcctgcattttcaaaggctcttgcccactgggaactacatggagaggagattaagaacaacaaccaaaagaggcagggggtggggcaggcttgaggtaggggtgggntgggntgacagtcaacacagctnggaccagaagnccatggnccctggctccctggaaaggcacagggcacagacggatgccgccttttcttgctgggacactcct

SEQ ID NO: 30 - DNA, 1804 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacaccgtccttcagaggccccaccaatttctcggacacttctcagtgtgtggaagctcatgtgggcccctgaggctcatgcctgggaagtgttgtggtgggggctcccaggaggactggcccagagagccctgagatagcggggatcctgaactggactgaataaaacgtggtctcccactg

SEQ ID NO: 31 - DNA, 1712 bp, Homo sapiens
atgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcaaaaaaaccggaatt

SEQ ID NO: 32 - DNA, 2625 bp, Homo sapiens
ggcagccgtccggggccgccactctcctcggccggtccctggctcccggaggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccacggtctccacagcactcctgacagccccgccaaaccagagaagaatgggcatgccaaagaccaccccaagattgccaagatctttgagatccagaccatgcccaatggcaaaacccggacctccctcaagaccatgagccgtagaaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatccttcactgctgactctgctgcctgcccgcacagcagcctgcttcccacctcctgcccaggccagccagcctcacccttgcgaaccgtgagcaggaaggcctgggtggatcggcctcctcttcaccccggcagccctgcagtgttcgcttggctccatgctcctcactgcccgcacaccctcactctgccagggcagtgctagtgagctgggcatggtaccagccctggggtgcccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagaccatgtaaataccagactgcaggttggacccagagattcccaagccaaaaccttagctccctccgcacccgatgtgacctctactttccagctagtccgacccacctcaccccgttacagctccccaagtggtttccacatgctctgagaagaggagccctcatcttgaagggcccaggagggtctatggggagaggaactccttgcctagcccaccctgctgccttctgacggccctgcaatgtatcccttctcacagcacatgctgccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctgcctggcctggccctgccctgaggaaggaggggaagctgcagcttgggagagcccctggggctagactctgtaacatcactatccatgcaccaaactaataaaactttgacgagtcaccttccaggacccctgggtaaaaaaaaaaaaaaa

SEQ ID NO: 33 - DNA, 433 bp, Homo sapiens
ttttttttggctttgacttgctttattgagcctgtgtgggagcagggagcaagctttggccagagccaagggtgcagaggggagagctgggctggcgctgctcatggagtcgtaggagacagaaggtggcattataagtccagcgggctgagctccctggggacagcagcatgcggggacccccactccgagaaggccagcgtgtcctctttgtgtcttttcccatacctaggcctggtcagcatgttgatgtatctacggagatcagctgcatactgggccatctgctctggtgtggcattgtcccctgggtacactggctccagtgggggctccctgggcacccagcagtggctgtagtaacagagccacgcaggtggacaggagcagcagggagaagcagaggcgtgcggcagccatccggatgtccaga

SEQ ID NO: 34 - DNA, 2878 bp, Homo sapiens
cccgatgagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgg

SEQ ID NO: 35 - DNA, 2110 bp, Homo sapiens
ggatccaagctattgtcctgcccatggcttcccatctcaggacgctctctggccgctatcatcccagcagtggagttcagcccactactctgaaccagccgcaggtggctgctatgggactgaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgtcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 36 - DNA, 1941 bp, Homo sapiens
cacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagca

SEQ ID NO: 37 - DNA, 1575 bp, Homo sapiens
agaaccgcgacctccgcaaccttgagcggcatccgtggagtgcgcctgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 38 - DNA, 1130 bp, Homo sapiens
ggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctccaaaaaaaaaaaaaaaaagg

SEQ ID NO: 39 - DNA, 342 bp, Homo sapiens
  misc_feature (232)..(244): The "n" residues at positions 232 and 244 are g and c, respectively, according to the corresponding sequence (PRO2389 gene) in the Entrez Human Genome Sequence Database.
gtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatanggcaggccctgncctctgggaaggtcccttcatgctggaggcacacagctttaaggaagtaggttgaagtaggactccttcgtcctctcactggctttggctccctcaat

SEQ ID NO: 40 - DNA, 824 bp, Homo sapiens
gaattcgaatgccaccctcccagatgggggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctggccaggacgctgtcatcgtgctgctgggcacccgcaatgacctcagtcccacgacagttatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctggacatgaggagcaaaggaagggggcaataaatgttgagccaagagcttcaaattactctag

SEQ ID NO: 41 - DNA, 1402 bp, Homo sapiens
tggggccggagaggcggcgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatgcttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgcgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccc

SEQ ID NO: 42 - DNA, 2103 bp, Homo sapiens
ctcgagatccattgtgctctaaagagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaaaatctctgctcagagaagtgcagggggagccttccagctcactctccctgaggactggcgtgacaggggctatgggtgttgtttttaaaaaaagaaaatatatttttttgaaaaaacgactgcccatcccgggtcctttccctgatgggttggggcagttacctggttgctgttttaattaaaaactttagagcacaatggatctcgag

SEQ ID NO: 43 - DNA, 556 bp, Homo sapiens
  misc_feature (287)..(555): Each "n" position in this sequence may either represent at least one nucleotide selected from a, g, t or c,  or contain no nucleotide.
  misc_feature (287)..(541): The "n" residues at positions 287, 305, 306 and 533 are g, g, a and a, respectively, according to the corresponding sequence (BASP1 gene) in the Entrez Human Genome Sequence Database.  No residue exists at n position 541 according to the same
ctgaccaataaacagaactacaggtgcacccaaccacggacatgcattaactcgtcatgagaaatctaggtaggctaagtaggatgagagaatgtttgtcactcccaaaaatatctggagaggaagaatggaggattggcattgagatccatgtggacaagctaagtgggctctgtctgaaagctggcattcatccacaacattaaaaaaatatcaaaataagaaaggctgtaaattaaaaagaaaacacagaaaatactgctctcataaagatctgattgccttgnacaggccctgtggagganntcaaacgcatcactcccaactcccattgcagaagaaaagctattcaactctcagcggtggaggagtgcatgtggcggcagtttcaggtacaaacgatgtactgcactttcagacgcggatcttggaaatccaggacttcttggtaaagttgactgaaggtatattagatatttccccacaaaaatactgtttggattctcccacccctccctcccttgatgggacanatcctggnattttccctgggcng

SEQ ID NO: 44 - DNA, 1317 bp, Homo sapiens
gcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagttataattttgtcagcaatgctattatctctaattagtgccaccagactagacctgtatcattcatggtataaattttactcttgcaacataactaccatctctctcttaaaacgagatcaggttagcaaatgatataaaagaagctttattgtctagttgttttttttcccccaagacaaaggcaagtttccctaagtttgagctagttgttttttttcccccaagacaaaggcaagtttccctaagtttgagttgatagttattaaaaagaaaaaaaaaaaaaaaaaaa

SEQ ID NO: 45 - DNA, 1385 bp, Homo sapiens
  misc_feature (20)..(1158): The "n" residue at position 1158 is nucleotide g according to the corresponding sequence (DBP gene) in the Entrez Human Genome Sequence Database.  No residue exists at n position 20 and 25 according to the same corresponding sequence.
ggggccccaaaagaaaaggnaagancctttgggtaacccaatcccaaagaagaaaacctggttttggtttaagcccccccctctggggcctcccttcctctcttcgctgggaacctgggtcccctctggacctttagtgctctccccctcttctcctgcaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtgcccacgggccggccagctgggtgccccagggacgtgataatgcagataaatacatttatatttttaagaaaaagcgagcctcccccctcccttgcgggggcggggagggttctctgtgtgtgtccccggcacgtcagggaccctatcctcccaccgcctccgttaacacgatcctgaataaatcttgagaaccccagagccagctgttgtggaagaagaggggcagcatccctggcatactggctgcagcccgtgggcagctccgggctgtcgtccatagagggcaggcgctgctggaagtgctggagtctgagtcctccctgcgggctgtcggatggaggaagggcagaaggtctgagaggaatgaagcgactgcctttattgcataggaccttttcaattgctttttagaattggggacggaggacgcgcatgagacgaacaggggatatgaatttccccgcccccacccgcggggagaggaacattagtacaaatcctagcgccggccccggggaacctgcccctcctgggctgattggccagctaaatggaggcaccggagtggatggggcgagccttcgggccctgaccggccgactcactgaggcctaccccagccagtacattccaggtcctgtcattgggcgacgcgtaaaatagactccgccctcagccatcctggccgggtaggagcaggtgncaagcgtcaggactgagccctgccccgtaagggcggccccagatcagacgccaggccccgccctcattgatcaggcactaccctcgggacgagcccatttctctttaaccgtgacgacgcccaccttccagcatcacgtctggtcccatgaaagcgagcgcaatcctgagacggggccagggcccctgccaccacaactctagcagccaggccacattccctagctc

SEQ ID NO: 46 - DNA, 1492 bp, Homo sapiens
tttttttttccagccaagcagcagctttattagtggtgctgggttcttcccataccctacagcgtgctcggaagcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggcagccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgacgatcagggccacgcggacgctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaa

SEQ ID NO: 47 - DNA, 1976 bp, Homo sapiens
gaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaagaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccccatagctggcccgccccatgcctggttattgcggccaatgtctttgctgtggctgcattccaggttgagaagcgcctggcggtgggtgccctgacggagcaggcgggactgctgctgcacgtagccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggctttcttccacgagtacctggtgagcgtccctctgcgaatgttccgcctctgggctttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcaaacccgctgccagagcccacctctcctcctaggcctcgagtgctggggatgggcctggctgcacagcatcctcctctggtcccagggaggcctctctgccctatggggctctgtcctgcacccctcagggatggcgacagcaggccagacacagtctgatgccagctgggagtcttgctgaccctgccccgggtccgagggtgtcaataaagtgctgtccagtgggag

SEQ ID NO: 48 - DNA, 839 bp, Homo sapiens
atgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctgggtgacccccgacccagcctcgctgggctgtcccctgtccctatctctcactctggacccagggctgacatcctaataaaataactgttggattag

SEQ ID NO: 49 - DNA, 4505 bp, Homo sapiens
cctgtaatcccagctagtgaggaggctgaggcagagaattgcttgaacctgggaggtggaggttgcagtgagccaagaccgcactactgcactccagcctgggcaacagagcgagactcccgtctcaaaaaaaaaaaaaaaaaaaaaatagtaagcatacctcatagagcagttgcaagggaaaggtaaattatatataaagcaccaagagtcatgcccagcatatagtaagcatggtgtaactgttagatgttattattgctgttatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatatggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtggagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtatttttttaacattttgtataatgattggaggttggtaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccaccaccaccaccgtcattccagcatgcagatctcagtcctgggttggtgttgtagggcatttatttatttgacttgacggcgcctttcaaagcttgcgaggatcccttcctcttcctcgtgtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccc

SEQ ID NO: 50 - DNA, 2740 bp, Homo sapiens
acacgctgcaaaaggcttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctcattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagggttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggctccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactaccacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtacc

SEQ ID NO: 51 - DNA, 2310 bp, Homo sapiens
gtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgagggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaaaaaa

SEQ ID NO: 52 - DNA, 1262 bp, Homo sapiens
attggaggggacagcggtatcctgggaagagccccagggcatgaatgtggggataaggcattgggaccctatcaggtatcctgaggagagactcccaccacgtatcctgagaagcacctcaccccctccagaccccaactcccatcacccagcttggtcagcttctcacaaggcctttctcctgcaggtaccatgatgtggggtgcaggcagccctctggcctggctctcagctggctcaggcaacgtgaatgtaagcagcgtgggcccagcagaggggcccacaggtccagccgcaccactgccctcgcctaaggcctgggatgtggtgctctgcatctcaggcaccctggtgtcctgcgagaatgcgctagtggtggccatcatcgtgggcactcctgccttccgtgcccccatgttcctgctggtgggcagcctggccgtggcagacctgctggcaggcctgggcctggtcctgcactttgctgctgtcttctgcatcggctcagcggagatgagcctggtgctggttggcgtgctggcaatggcctttaccgccagcatcggcagtctactggccatcactgtcgaccgctacctttctctgtacaatgccctcacctactattcagagacaacagtgacacggacctatgtgatgctggccttagtgtggggaggtgccctgggcctggggctgctgcctgtgctggcctggaactgcctggatggcctgaccacatgtggcgtggtttatccactctccaagaaccatctggtagttctggccattgccttcttcatggtgtttggcatcatgctgcagctctacgcccaaatctgccgcatcgtctgccgccatgcccagcagattgcccttcagcggcacctgctgcctgcctcccactatgtggccacccgcaagggcattgccacactggccgtggtgcttggagcctttgccgcctgctggttgcccttcactgtctactgcctgctgggtgatgcccactctccacctctctacacctatcttaccttgctccctgccacctacaactccatgatcaaccctatcatctacgccttccgcaaccaggatgtgcagaaagtgctgtgggctgtctgctgctgctgttcctcttccaagatccccttccgatcccgctcccccagtgatgtctagctgagtcttcatgacccttcaaccctgattactacagaattccagaatgttaggctctccagggcttctttccaaac

SEQ ID NO: 53 - DNA, 1026 bp, Homo sapiens
cagcatgttgagccgggcagtgtgcggcaccagcaggcagctgcctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaactggactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctag

SEQ ID NO: 54 - DNA, 1239 bp, Homo sapiens
gaattcggcacgaggtgaaaggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagacggacagaccaggcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttcgagagagcaggggtaccaaggatcttcctccagtgaaggaccctggagccctatccagggaggggctgctggccccactgggtctgctggccatcctgaccttggcagtagccacactgtatggactatccctggccacacctggcgagtaggccaagaaggaaaatctgacgaataaagacccccgctgccccaaaaaaaaaaaaaaaattgcggccgc

SEQ ID NO: 55 - DNA, 55 bp, Homo sapiens
ctgcgtagtacagtgccaccgctgccgtgtgcgcaaggagctcagcctctgcctg

SEQ ID NO: 56 - DNA, 1835 bp, Homo sapiens
  misc_feature (44)..(71): Each "n" position in this sequence may either represent at least one nucleotide selected from a, g, t or c,  or contain no nucleotide.
ttacactttatacttccggctcgaatattgtgtggaattgtgancggataacaatttcacacaggaaacanctatgaccttgattacgccaagctcgaaattaaccctcactaaagggaacaaaagctggagctcgcgcgcctgcaggtcgacactagtggatccaaagaattcggcacgaggcgacgggcggagcggagcgcggcgcgccggggccgccgccggggggatcggctgcctccccgggccgggtgtagagagggcgggtccccggcctcgggagcacggcggtggaggggacataggaggcggccatggcgacccccggcaacctagggtcctccgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaactgcgggaagaggtttggaattgatgttcaagatttccagaattccctgaccaggagcgcacccctccccaacgactcccaggcccgcagtggagctcgttttcacacttcctacgacaaaagatacatgatcaagactattaccagtgaagacgtggccgaaatgcacaacatcctgaagaaataccaccagtacatagtggaatgtcatgggatcacccttcttccccacttgttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacagcaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgagccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcayctcggacagcatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcccgcgtgtgcatttaaagcataaattaattaaacagccacttcggtca

SEQ ID NO: 57 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 58 - DNA, 2334 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 59 - DNA, 4398 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactgggtggattgaaggagctgcaatcctcttgtctgtagtgtgtgtggtgttagtaacagctttcaatgactggagtaaggagaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaagggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcagg

SEQ ID NO: 60 - DNA, 1421 bp, Homo sapiens
agcaagatggccacggtcatccccagccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccatacgcctctgggcgggcatggggggtggtgggtgccagccaggggcatggacagagcctttttctaaagaaaaagacaaaaagttaaaaaaaaaa

SEQ ID NO: 61 - DNA, 2214 bp, Homo sapiens
ttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggacagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaatgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcagatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcggttaataacaggcaaaaggaagcagggttggtttcccttctttttgttcttcatctaagccttctggttttatgggtcagagttccgactgccatcttggacttgtcagcaaaaaaaaataataataataataataaggcctgctgtgtaagctgacagtatttgtagctgatagggggttgggaggaagtgtctactaggagggtgggtgagatctgtgttgatgt

SEQ ID NO: 62 - DNA, 675 bp, Homo sapiens
agtgtccttggggaaaccaaggcctatgtcttctttgagaagagctttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaa

SEQ ID NO: 63 - DNA, 1651 bp, Homo sapiens
ctgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccacagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatataacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggc

SEQ ID NO: 64 - DNA, 4627 bp, Homo sapiens
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagagtatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcctatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatatagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggcgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcctctcaatcttggtttttcagttgatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttaaagtaacttatttgactatgaatattatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgac

SEQ ID NO: 65 - DNA, 1445 bp, Homo sapiens
gagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccggctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaaaaaaaaaaaaaa

SEQ ID NO: 66 - DNA, 1594 bp, Homo sapiens
gcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtag

SEQ ID NO: 67 - DNA, 6642 bp, Homo sapiens
tgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaatagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtccctggccatgagcctgtctccgaccctgaagggcaggctgttgctgatgaggcccaaggcaggaggaggaagggagcaggccgctcctgggagaaagtccaatgagagcagatcccttggccacctttgtatggaaagagccttgacctcaccattaaaagtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 68 - DNA, 126990 bp, Homo sapiens
gatcaagccactgtactccagcctgggtgacaagtgagactctgtctcaaaaataaaataaaataaaatgaaataaaaaacagttgcagaatgattgaataaaattaatactgaagaaaacattcacaagttagataaacttatacgtaccagccaagcctcgcataaggaaatgacaagaagtaagatgctaaggggctggagacgtgcttttgtgacaactgagagccacctatgaacattgtccttatgttcctttccaaagccttgtagataaaggacatggaatcctgaaataaaagaatcattatagacagtaaagacacgtagcataatcaacaaagctactgtttcctgtccaaagtattggacttgtgtaaaggaaatgagtttttagaagtgctaaacaataaaataaaacattaggtcctatcagcaagtaagatcacttaggacaggcaattaggatagtgaaatcatacccccaaattatgctgagggatggcagagttacagcccaagaggttgggaccagcatgggtagaaagagttatcgctctgtcaccaggctggagtgcagtggcacgatctcaactcactgcaacctccgccccctgggttcaagcaattctcctgccttagcctccctagtagctgggattacaggtgctcgccaccacacccagctaatttttgtattttagtagagatggggtctcaccatgttggccaggctggtctcgaattcctgaccttaagcaatctacctgcctcggctcccccaaagtgctgggattacaggcgtaagccaccatgcccaggggactaaaattttttaaaagacaagtctgtccatgtgcagtggctcacacctgtaatcctagcactttaggaggctgagacaggaggatcacttgaacccaggagtttgagaccagcctgggcaacatggagaaaccccatctcaacaaaaaatacaaaaaattagccgagtgtggtggagcgtgcctgtaatccctgctacttgggaggctgaaatgggaggatcacctgcatccaagaggttgaggctgcaatgagctgagatctcaccattgcactccagcctgagcaacagaatgagactctgtctcaacaacaagaaaaagaacaagtcctttcaatgcagaactttaattgtatttgtatatgtgtatatatattaacaaacaaataaactggaacaacaggatgccaaagatatcctccagaccggccaggcgtggtggctcacgcctataatcctagcactttgggaggtcaaggtgggaggatcacaaggtcaggagttcgagaccagcctggccaatatagtaaaaccccgtctctactaaaaattagctgggagtggtggcgggcacctgtagtcccagctacttgggaggctgaggcaggaaaatcgcttgaacctgggagatggaggttgcagtgagctgagatcgtgccgctgcacgctagcctgggtgacagagcaagactccatctcaaaaaaaaaaaacgatatcctccaaaccacacccaagctgagatgtggttgtatttgctgccaggcaggcacgagaggtcacatgcagaatgctaggagccgtacaccacagaatttgggggacaacaagcccctcagcttgggatgctgaatcgttcttaatgtggttactgcagagacaaaaaacacaaacgagagtggccctgaacaagctggccagatactagatccatccaagttaaggggacacaactctaaatctgcccaagggtgacatgagaccaaacaagatttcctaggtctgctccaaagcagagcacagttggctcagagcatgaaggcagcccagatggctcaggcgctgcaaaagcacagggtctgaggatctttcaggcacgagtatgccttctgctttgcccattctaatctcactggcaggccatgcatagattgcttcatcctaaagcctagctctgacttgctcattcatccaggaagcaattaatcagctcctactatatgccaggtaccacagcagacactgggaacataaagtccctccttagacaattcatttttttgcaaaggagaaaatccaaatatggcaagacaaaatgacatgtgctttgatagaggttcccctccccggtccggaccagctacataatttaaggaggccagggcaaaattaaaacatgcagccttttgttaaaaaaattgttaaagccgggtgtggtggctcacgcctgtaatcccagcactttgggaggcccaggtgggcggattacctaaggtcaggagttcaagaccagcctggccaacatggtgaaaccccatctctactaaaaatacaaaaagtagctgggcatggtggcgggtgcctgtaatcccagctactcaggaggctgaggcagggaattgcttgaacccgggaggcagaggttacagtgagctgaggtggtaccactgcactctagctcaggtgacagagcaagactctgtctcaaaaaaaaaaaaattgttaagaattttaaggcagtgacagcagtatattaaacctaaactaggcccttccgcaattctcagagaccccattcacaaagttgtctaaacccttctgacattaagagcccactacaatccaatgcctacttagcttcctaagcctctcatagtaactcatattccttgtcctgtgctccaggcaaatacgactactcagatttcccaacacctgaaactttcccaacccactaacagaaatgtactctcactgatgaaatactatctactgtccaagacctaacttgaatgtcccctcctccaggaagccttctctgtctgatagcctccaaggtgaagcttttctccctgctattttttttttgttttgttttttgagacagggtgtcactctagcacccaggctggagtgcagtggtgcaacctcagctcactgcaacctctgccttccaggaacaagtagtcctcccacctcagcctcccgaatagctgggactacaagtgcacactaccatgcccagctgattttttgttacttttttgtagagacagggtctcattatgttacccaggctagtctcaaactcctgagctcaagcaatccacctgcctcagccacttaaagtgctgggattacaggcgtgagccaccacgcccattctccctactatctaatgatgcacttaccgcaccatggtatgtgttgcagtctactcacataatggttatttttgtatttgtcactcctttcagactgaaattttttaagggtcagagttcatttgtctttcattttatatcccccagtagagtgtcttcacttaacagctaacttcattgattaatttcatacacaatggggctatgcacagtgagccttcaacattgtgaacgcctttgggactaagtccaaagaaggattggcctgggtgcccagggtcatcttgacttgacagagaccactgaggtgcagactcagggcatctccagaacaaaccacatatggatgccaagagtatttgccggcctggcacatgcttagacccaggctggagtgcactggcatgatcatagctcactgtagccttgaactcctgggctcaagcaatcctcctgccttagcctcccaagtagctgtgacaacaggcacagccatcacacccagctaatttatttattttttatagagacaaggtcttgctatgttgcccagacaggtctcaaactcctggactcaagggatcctctcaactcagcctcccagccaccacatcccaccacaggtaaatttcaatggacaaataaatacccagggactcagcgaaacaaggtatctcaagaagcagcattcctctttctcaacttagagcagaaaattcttaccggggtccaggaatttacactaaagaacactcctctttcagtatagtttatattcctgtcaacactttcagttagggatgtagtcaaatttctgtgaaaatcatttttctgcatttttgagctgttgaagagaaagaggaataaactggttacgactgagaaaacaaccccctgtaaaactgagttgaagaatatagtcaagttaatcacaggttaaaagaccacaaaattttaacgtcagaaggctgaaggagcaacacagaaagttttagaaaaccttcatttcacaaaatcttttagtaaacacatttctaaggcttaaaagcctatccttataaaacatatttcctataatatcagagctctatggtaggagtaaaaggcttcaattctttccagattatgaaaaaatttagcaacaggtatcagctggtggggaaactgctttgcaagcatactgattttttttttttttttttgagacggagtcttgctctgtcacctaggctgcagtgcagtggcacgatctcggctcattgcaaccttcgcctcctgggttcaagcaattctcctgtctcagcctcctgagtagcctggaactacaggcatgcaccaccacacccagctgatttttttgtatttttagtagagatggagtttcactatgttggccaggctgggctcgaactcctgagctcaggtgatccacctgcctcggtctcccaaagtgctggaattacaggtgtgagccatcacgcccagccagcatactgatttatcttcaaagacatgctaaaattaattatacaataaaaatacattttcacattcaaagatgtcaaccagccaaaaagcagatgactcagggagccagagaggcttcagaaatgactgaagtagggagtggacaacagccgtaagtgacggggccctgggcatgacaccaactagtgtcagggttctggcaaccccaagaaagattgcaagcctaatcaaaaggtgctcaatgtgattaaacaacaacaaagtatgttgaaggaatggtttgctaggaaaaaaagaaaaagaaaaaaaaaagttacccaattcaaatacaacaatgacgacttcactgaacactttctgtgtaattttcattcttccaaagtgctaagatcattcctctcagtacctttatcattgcaatactctacttttgagtatatctcactcttgatcatccttaaatatcccggttaagccatcacttcttcaaggagagctcttttgtgcccagggccaggacgctctgttgcaaatccccagaacaccctgcatttttaattcctgacacttaaatatctgttaagccatcacttcttcaaggagaaccctcctgtgcccaggccaggacgcttgcaaatccccagagcaccttgcattttttcttcctaacacttaacaatgtccacaattacttgtttagtgcccagctacctgccaggccatatacctgagagcaggaactgtttctgtcttgttcacaatgatatctctagtgcctgaaccagttcctggcacgtactgattaataaatgatattttattatttgtgttattttgttctattttattaataaatatacacatatttgtaatattaataacttattaaatgaatgcataaatgactgtcggttggtacctgactccagcagaaaatatcatttcttaaaatacaaaccaggcttctggcccttaacattgagggcttctcccaacactgtctcatcaataaataaattttcatgtaaaatctgggtgaagtttatgagtaagacaataatattgatagttacaataatactaactacatttcttctttctttttttgagacaggatctcactctgttgcctagactggagtgtactggcctgatctcagctcactgcagcctcgaactcctaggctcaagcaatcctcccgcctcagcctcccaagtagctgggactacaggcacacaccaccatacctggctaattttgttcattttttgtagatataggggtctcactatgttgctgaggctggtcctgaactcctggacttaagggatcctcctgcctcagcctcccagagtgctaggattacacgtatgagccactgtgcccagccactaactaccgtttaatgagcaactcaacatgtgctaattgctttacatccaccactgcatgtcatccacaccataattctgggagtgttgatgtgctttttccattttgcaaaaggaggaagctatagctccaaaaatcaagcagcttgtttaaaaatcacacagctgcaagtgacaaatctggaatttgaacctacagctgtctctcaacagatcccgtgttctcaacctctatagggcatctcctccaggtgagatgtactttttctatgaacaattttggaatccacttacccctgggtgtggttttgctggccgccacatgcaatgaacagagggttctcaggcaggttgcagtcactgaggaaacagtcaaatgagttagccatttatctacttcttcacaagcatgaattttaccgagaatcggtagtgcgcttcaatcatctcccaaaggcttaaagtgtttattacctagccatacaggactaattaagagcccatgttctcccagagagggtgggtaggctgacggttgtcactatcatggtaatccaggaaggctcatgctgccagtcaccccagactcagccttcctcttccctccccgctccacctgctgagctgttccacgctaacacgaaacgtctcagaatttgagagtgttatcaacactggttaccaattatgtcaccttctgcccaattatacacatttatgcctaaatgtgtctgaatttctcaatttcatttctttaaaaaaaattccataatttcaataattaaatagctaatgaaggatccccttttacaagtgaaaaagcctctgagaacataagagataaactcttcccaatagaggctttcccccaacactgaacagaagcactgaggaagcaggtattaatataagaagagtattctggaatgaagactatcttaagatttgtatggaggtcactgagggaggctggggtaatacaaaagtaatgtggagtgtaggggtgaagaaaattagttgctgaaaaaggaattccaaaaaggaggtgggaaaaagctgaaggcagactcttcctaccaaaacatttctctggccaggtttgagctgaggaaaaggttctctctttggaccttttcttgtccaccacaggacacaaaaggcagccttacagcattagcactatactttcaaatagagtttgaggtgagtagagttcttggcaatgtaactaccactacttcattgcttttttaaggaaaatataccaaataacataagtgagctttggaagataacctgtgttagtaagctgggaaatgcctgttactatgaacatatttatgttttcctttctgttatgaatttttttgtgttgtctctttttggagacttctctgaatttcccatacattttcataaattctgatgaatctttctttgtatatgtatgcaaacaagcaatcaactcatggaattttacaccttggtaaattgggacagggatcaagagacaagaaatatgttctttctcaattatcttttcctaacgaaagaataaggtccagctatctttccttagctatttggagaaccaaaccaaaattgaacaccaaaaaatgttttccagtttggattatataaaacaagtaagtgcaggtcaatcactcaaacatgcccttatgttatgagtccttccaatacaaactttgcttccttctaataataatagtaaccaatacttagtaagtgcttactctattctaaaccctttacatgactgatctaatttactcctcacaaaaatcctatggtaaaaatagtattgctgtcccaattttataggtgaggaaataagattttggaaggtttagcaacttgttccagataactcagtagtgagtggcagatcccttaaattctgtacaaccacggcagtatgcacctaaaaacccaggtccacgggagagcttggggattttagttgaggtttatttcactattaaaagtggcattcatatgagattgctatccctgccaaattgttactcaccgattgttaaaaacaagtttattatgtaccaagctaaggtcgaatttgtcatcaaagggaattttgtttcaaatcaacacaatatataattatggttaacactgtttgggtactagcaaatgtttataagggtaaaggaatatcacccagtataatattctggatctacattctgtaggccattccaacttatgaacagctaactctgctatgatcctgacctggaacagtctcccaggcacaggtcccgcccagagaaccctctttcccactgctggtggtacagcctaagcttcccgctctgccctttccccgattcgggggctgccctgtgcttcctagccacacccacatctcaacccggttcaggtcagtagtggggagaggctgcatgtccaacagcatgatcagaaatgggttctctgggccaggcatggtggctcacgcctgtaatctcagcactttgggagacagaggtgggtggatcacttgaggtcaggagatcgagaccagcctggccaaccaacatggcaaaactctgtctctacaaaaaatacaaaaattagccaggtgtagtggtgagtacctgtagtcataactactcgggaagctgaggcaggagaattgcttgaacccaggaggtggaggttgcagtgagccgagatcgcaccactgcactctagcctgggcaacagagcaagactctgtctcaaaaaaaaaaaaaaaaagaaaagaaaagaaaagaaaagaaaaaaaaagaaatgggttttccggccacgcatggtggctcatgcctgtaatcccagcactttgggagtctgaggcgggtggatcacttggatctcaggaggtggagaccagcctgggcaacatggtaaaaccccatctctaccaaaaatacaaacaattagcctggtgcagtggtgtgagcctgtggtcccaggtactcgagactgaggcacaagaatcacttgagcccaggaggtggaggttgtagcgagctgagataatgccactgccctccagcctgggtgacagaacaagaccccatctcaaaaacaaaaaacaaaaacacatgtgctcttaaaaaaaaaagaaaaagaaagaaatgggttatcagaagggccttggctccctctgatctaggggtagtgtaagactctgtgagagtctaatgatctactacagctagaagtggggacaatcacagtctaccttatctatatttcggctgagtttctgattaattcttgtcctgagcatgcttaggagaagaaaaggaactggaggttcagcagctgtcccatctgggctagatgtcaaatttcaacagaatgttttacaaatgcatttatttctcattttacgttggagtgtgtgtcggggcatgtagctatagctctatttgcttctgtttttttagtattaggtgaggtatcctttgacaccctgaaaccctgagagtgtagtcagggtggagaggtgtgtcaccacagcaagaacacagccactctgggacctgtggagacctggcactccagcccccagcatgggttttcccaaaagaaacagatggaggctgggtgcagtggctcatgcctgtaatcccagcactttgggagaccaaggcaggtggatcacttgaggccaggagtttcaggccagcctggccaatatggcgaaacctcatctctactaaaaatacaaaaaaattagccagggatggtggtgcacacctgtagtcccagctgattgggaggctgaggcacgagactcccttgaacccaggaggcagaggttgcagtgaagccgagatcgtgccactgtactccagcctgagcaacagagcaagactctgtctcaaaataaaaagaaagaaacaaatggagcaccacctgtggaggctgattcctgcctggctgagccatttctcacagaccccaaatattgcaataactgtctctctatttctaaaacacgagcagcatcaaccaagccaactggatgggaaccagtcaagtttataagatcactgagtttccattctttccctctttgaataggttagaaaagcacttcatgagattgttttgttttgtttttatgtgatcagttgaaaaacctgagagttatgttgggggatggggtaaaaaggcagagagtgattggtaatagaaatgcaatatgaattcacctggtcccattctccaacatgaagcttgttagatggtaaatattagtggaccaaaatgccatatcatccagtcctccaagaaaatactcttggaattgttccaccaaaaacggggactttgtagagtaagtgggatataactatggcagagagaaagaaaaaataaaatgaatatggtactattcctggtatctttataatcctttaagatttggaagaatgacgcctttaccttggaaacagctagcatctcaccatacctgcaaaataaacaataattttggctgtgagttgcagtttgtaacagagaaatgaagcaaataatgaagaaaaagttccatccacccttttccaccgtcatgcaactgcctttgaataagcagaatccataaatccaaaatccagtctcaggaaacaaaaacataaaaactgtgcaaaggaagtcacaacaaaatcagctgcaaattgtcctctgagttacgcttacatttctaagaactggatatgtgaacaatcaacgattacattttcggtgatgacttttcgaccatacagtttctcataaattcccagtagatctttgactggcacatacctgaaaaatgcagaataaagtaagagttgttttgattctgaagctgaaaatagtaacaacagcagcagcagctaccagttattccgtgattattttgtgccaggcaccatgtaaaagtctttacatgcaccagttatttaatcctagcaatgacctcaggtggttagtactatcatattcccgttttacataagaagaaatgattaaggcacagaaaagttaaataattggcccaatgatgcagagcaaacaactggtaacttaaatcaaatatttatgtaggtatactcagattggaaactaactataacgtacaaaaagagtggttaattttgtgaattcagagttcaagaagtaatttaaagtattttcatggtttcaagttgaattgaaaagaattattttaaaaacactattataaaaatgtctcctcaccctgacatcttaatttcagagtatataaagtatacaaaaaagtataccaaagtataaaaatattgtaaaggaaaataaatctcagaaccccaaaatcactaaactaaagggaaaagtcaagctgggaaccgtgtagggcaaacctgcctcccaatctatttctgtgtggtttctgtgtggttgtttttgttttctgttttttgttttttttttggagatggagcttcgctcttgttgcccaggctggagtgcaatggtgcaatctccgttcaccgcaacctccgcctcccgggttcaagcaattctcctgcctcagcctcccaagcagctgggattacaggcgtgtgccaccacgcccggctaattttatatttttggtagacatggggtttctccatgttggtcaggctggtctcgaactcccaacctcaggtgatccacctgcctcggcctcccaaagtgctgggattacaggcgtgagccaccacacctggccctcccaatctatttctaagtgagattgctacaaagattaaaagctacatacctccctcacaatttgcccacaaggaaattcatgtgggcaaaggacagatagaactcaaatatcatccctctgctcacctgagacaaatgtatatctgattgcttcctttgcctaattgtttcactaaaccagactacagcataagtgacactattactgtaaactgcattttcagtgaaaggctaattggaaattcggaaggatgtctcatagctacctatgacctggaagcctcctcctcgcttcgagttgtcccatctttctggactgaaccaatggacattttacttatttttttatttttattttttttttgagatggagtctcactctgtcacccaggctggagtgcagtggtgcgatatcggttcaccgcaacctccgccttccaagttcaagcaattctcctgcctcagcctcccaagcagctgagactacaggcatgcgccaccatgcctggccaaaacaactgacctgtaaggggactgaacctgcgaccctggtgtcattagcaccacaactgagctaactggccaacagccatttcgcatttattgattgatgtcccaagtctccctaaaatgtacagataaccaagatgtgctccaacagccttgggcacatgttgtcatccggacctcctgaggctgtatcatgggtgtgtccttaatcttggcaaaacaaacttcctaaattgattgagacttgtctcagatacttcttggtttacagtataaagcaatgaaaagaattctaaatcaggcttttggttcacaaatattagttatttccattgcaaagagcagcatttaaaaaccagatttatactcaatcatcttttaatttaaaaatcctcaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaaccccaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaatcctcagaataaacaagataaaaaatcgcaaccaataaaatctaactttagtaggtttcttttagtaggtaaaagaaagaaacaattgagagactcattttttattttataagagcactggaatggcattcccaataaaaatagcttaaaaagtcagacaaaataacaaaaaatatttttttaaatgaatcaccaagctagcaggacagcagaaatttttcaaaggccaaaaacaactagaaacaaaaaaaccctgggaggtaagcaaatgggacaaccagcttttgccctgagaacgtgtgccacaccctacacgttaggtttggaacctggacggttttttttttgtttgtttttttgagatggagttggagtctcaccctgtcgcccaagctggagcgcagtggcatgatctcggcagttcttaacttgagcctacttattctagcaccatggaatatcaccaaacatgaccagtataactccagtcacatctgataaaggagactttaatgcagcaactattattagagataaagagggattttgcctcacgataaaaagctcaattcacaaggtatccttttgaaattgaatgtacctaacaatatatcttcaaaatctatatagcaaagcaaactctgacagaactacaagaaattgaaaaatctaccctcatgtgggagatctttgaaactaatttctctcttaataatcagtagataaacctgataaaaagtaaagaaataaatagtgatgttatcttacttataacttacaaatctttttatttgaatggtaaatttttttttctttttttattttttgagacggagttttgctcttgtctctcaggctgaagtgcaatggcatgatctcagctcactgaaacctccgcctcccaggttcaagtgattctcctgcctcagcctcccaagttgctgggattacaggcacgtgccatcgtaccaggctaatttttgtagttttagtagagacagggtttaaccatgttggccaggctgatctcgaactcctgacctcaggtgattcacctgcctcaccctcccaaagtgctgggattacaggcatgagccaccgtgcctggcctcaatatttcaaaattgttaattttccaattcatctctagattcaataaacacttaatcaaaattccagcaaagtttttcttggaacatgacaacttgagcctaaatcttatttgaaagaacaaaggcaaagaataggcaaggtacttttgaagaaaaagaaggactagttataagatctgccctaacagagcccaagacttattataaagctacagcaattaaaataatcaatattgttcagggaccaaaaggacatatcagaaagcccagaaactgacccatacatatacataacattttaatttataacccaaagggggtgcagtggctcacacctataatcccaacacttgggaggccaaggtgggcggatcacttgagcccaggagttcgagaccagcctgggcaacatggcaagacctcatctcttacaaaacattaaaaaattagccaggtggaggctgaggtgggaggatcatttgggcctggaagttggagtttgcagtgacccaagatcacacaccactgcactccagcccgagccacagagttagactggctcaaaaaaaaagacagaaagaaacagaaaaccaaaacagagaaggtattgtagatcagcaaggaaaggggagactattgataaatcattctgggacaatccattatctccagaggaaaaaataaaattagatttacatctcagaacatacaaaaaattaactccagttaaatcaaagacataaagctaagatataaaactataaaagctttagaagtccatgtaagagaataaccatttgccctcaaggtagaaaggttttctttctttttatttaagagacagggtctcactgtgttgcccaggctggagtgcagaggcgcgatcatagctcactgaagcctcaaactcctgtgctcaagtgatcctcccacctcagcctcctgagtagctgggactacagatgctgtgccaccacacctagctaagaacggatttcttaaataagacatcagaagtacacattacaaaggaaaaactgatctattcaactacatgaatattaacaaatcctgtttgtcaagatacacaataagtgaaaggacataccacaaactgtgaaagacatttgtaataactaagtgacaaactgacaagagagtagaagccagaatatataaatactcacaaataaataaaaaggataaacaacccaacagaaaaatagactgaaaactggaaaaagttttcacttaaaatcaaacacaaatgatccataaaatagaagaaaagtgtaacctcattagcaatctgggaaattcaaactgcaacctcaatgagataccattacacacaaacaggctggaaattttaacagttggacaataccaagtattggagaatgcagaagaaccagaatgattatacaaagctaatgggagcataagttaagatgatcattttgaaaaagtaaactatgactcagcaactccactccattcaaaattgagtggaattcaatttctcaaagaatctaaactatgctaatatgcaattttacttttcaaaatttaccagtgcagaagacttctaattatattgtcagttatattttctaagaaaaaaagtcaaggctctaaatgccacttagataccacatatttagatgtacattgctcttaccagcgtcgtgcaaggtaattaaaattaaattcaaactggctcaacacatctcctcctagggtatgagaaaaatattgacatttggtggattagtgacaaacatagcatgcatctattcaacatgaggtctgacaagttggattattagtttttcacattattacatgtttttgttcattgttttaggtaaaggcatgcctttttttttttttagacggagttttgctcttattgcccaggctggagtgcaatggcgtgatctcggctcactgaaacctccgcctcctgggttcaagcaattctcctgcctcagcctccctcgtagctgggattacaggcatgcgccaccacgcccagctaatttttgtatttttagtagaggtggggtttcaccatgttggccaggctggtcttgaactcctgacctcaggtgatccacctgccttggcctcccaaagtgctgggattacaggtgtgagccaccacgccaggccgcctttttttttttttttttttttaagaaaaaattatcttttaaaaatcttagttagtgaaacatataaattaagaaagaactggccatataaccaaaggtgttttttgttttactttaaggaaatatcgaccataagggtttaataaacaccattcaccacctagtttaaatatttaaaagcaatttactactacaggcaaaaggtggagtttactagtttaaagctaaagtattaggaaagtaggagacactagctaatgaattttaacccaatgtataagtaaagtttttctaaaattatgacatgtcaacaacaaagtgtagaattttttaacaaaaaaatacatatagacacaagtttttagaaatacatctctatgttaaatgaggtacatctctactctaaatgaactgcaacattaaatagaaaatacatgcaaccagcaaaatattaaagacacacatatttaaagcacagtagtgatgtcattataagtgaactataccacgagaaaatttagcaaatgtaaataaacagtaccaaaatcaccagccgaatgagcctctgaataggagccgtgaaaatcaatctaagaaagaaagagaaccatctggtgtgtattacaaattgtagccccaactcttacttccacagtcaagcaagtggtgggagatgacagctaactcaatgaactgctgaggacgcataatagactcaattttcacactaacattttattagtaaaaaaataataataataaaaaggcagggcgcggtagctcacgcctgtaatcccagcactttgggaggttgaggcgggtggatcacctgaggtcaggagttcaagaccagcctggccaacatagtgaaaccccatctctactaaaaatacaaaaaattggccgggcatggtggcgggttctggtaatcccagctacttgggaggctgaggcaggagaatcacttgcacctgggaggcagaggttgcagtgagccgagattgcaccactgaactccaacctgagcaacaagagtgaaactccatctcaaaaacaaacaaacaaaaaaacaacaacaaaaaaaaccacacccacatacacacacacacacacacacacacacacacacatatatatgcagctgagttggatacatatgtctggcaataaagctactacagacaactctgccttataggatatatataaaaatctctgagttgaagttgaaacttctaacagaatgtaattaacataaattaaggaccagggggccttccagaggctaagtcatcaggtaagatcacaattttcagtttgaggacatggcattttcatatagaaagttaaaaagagagagaaaaagtccaataaagtagaagtattacttttaaatagaaccaagtggcaggtattcatatccttcttaagatatacagcttgaataaagcataagatttatcaattatttttgtgactaaaacaaaacatcacatctatgactgttttcagtacacattagccactctgctcttgtggatgaatctacccagttggcaagaagaataaaaggaatgaattggaccgggcgcggtggcttatgcctgttatcccagcactttgggagaccaaggcaggcagatcatgaggtcaggagatcaagaccaccctggccaacatggtgagaccccgtctctactaaaaatataaaaattagctaagcatggtggcacgtgcctgtaatcccagctactcaggaggctgaggcaggagaatcacttgaaccagggagttggaggttgcagtgagccaagatcgcgccttcgcaccactgcattccagcctggcaacagagtgagactccatctcaaaaaaaaaaaaaaaaggaacaaattggaaaagatgggactctaaccaaacactgctttgggcagaagtctgaataacctaacattttcctttcttttaaaacggtcaggttttgatcttaggtgagacagtatcactcccataaagtcattccccataaagggatgtactcacagctcccatggtcctaaggaatccttgttcaaggcccagactatgccagctgacatctgccgccatgtgagaagtaattccaaacaagaaagctaccagtttctctgtgtcctgccaaacaagcaaattagagtcatgtgtgtttgggtgattttataataacaatcctattaaaagttttaataaatataaattcatttatgttactgagacctaacaaaaaatttcaggcaagtaaattgcagtttctagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctgtctcaaaaaaaaaaaaaaccacacacaggccgggcgcagtggctcacccctgtaatcccagcactttgggaggcctatgcaggtggatcacgaggtcaggaaatcgagaccatcctggctaacatggtgaaaccccgtctctactaaaaatacaaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtgacagagcgacactctgtctgaaaaacacaaaaacagaaacaaaaccacacacacacacacacaaaaccataaggacttttggaaacgttttacgatgtgttggaagtgctttcagattaattactattggagcaaaatgatgaagtgatgtatcccaaaccgtgtttataagtaattcaagtattagctagccatctactatgtccaagcaatgtgcatgacactgaaggtggaatggtgggcagcccttacagagcggtacaaatggggtcaatgcgggtgcaaacacagtgcatggcaggtttggtgctaaatattttaaggattggaggaccacgcctaccttctcccagggaaggggatagttctctcggatataatgaacgcttgcattaagaaacggagtccagtgagtgctctcagacacatcatggaattttcctgacaaaacaaaagcagggctctagattctctcttaaaagttggagagtctcaatcaaatcttccacaccacccgctgcgctgctgtgtcccttctcctccttccctccatgcccctcagtttcttctgtcgactttcaaaagaagcctctaaaacggaagagccagctgagattttggaatacgcgtggtactgtctgcctgatgactaaaaagagccctacagtaagagggacggagcctaaactggctcacggaatcgcaagcccggctacctggttagaatagaggctagaattgtttccatttctgtgccctaaaactaaggaaacaagttgtactttggttttgtttatttgttgggattttaaaaagtatcttccttgtccctcacagtcagcctccttaagagtacaagaaataaaagcagatatttcatatgctttcaagcatttgattttataataattattgcaaaatggcacaggccccagtgagcattttatgcaagtgtcgtttgagtgggccagtgcgtgtcccatgtagctctttattcccacaagaggggtaggaaagacagaactggcctctgtgctaaacctccaagagccacaaatgcctcatggagtgccaaatgttacgagggtaactaaaagcaaaactgccgagttcagatccctcagttcaatttttctatgccgttcctaaagtaaaaattgccgaaccagttttaaatcattggttttttttcaaaatgattttcaaaggagttagaatcaagacatttgatttgctcccacagttttcctagagataaagctttaaacaattcttgttctccagaatacagtaaaactccagaattaaatatggcagtagctcttttgaacaacttcaacttaaacaaattggcagattaactgaagctttctgatccctctgtaaatccaacagactggaagcagaaagtcccccaggacatactagatgctgacagctggcaagccactgcccagagacttgaacttacctgtctataccatagctcacaaagggtcaatcagacccacttctaatcctgtttaaaccagatgtccttgttactgtaattacaaaggctaattcagtattaggtaaactaatacaaatgaagagttttgctgggtgcagtagtgcacgcctataatcccagcactttgggaggctgaagtgggaggaccccctgaggccaggaggttgagactagcctgggcaacatagcaagaccacatctctacaaaaatttaaaaataaaataaaaaagtagccaggtatggtggtacacacctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtggaaaaatgcaaaaaaacctaagtggaataagtggaatttgtatgcaaattccctgtaactagtcatataccagtcccaatcttttcatcacacaagactatttattgctgcagaaaaaactggaaaatgctaggtaaatactttacattccttttccactctcctcagaaccttgattagtgtgggttttgtctgtctctaaaaatggcgtacattaagcaatgttgctcaaattgaatggacaaaaatatcctttcttctttcttttttgtagaagctatcaagggacagtagagctcccatgaatacagtttgggaagtgctaaattagaaataataggttagaaaggagaactataacatgcaggcaaaataataggattgagaaatgatagttaacagactaagagggaaacagaacaaaactccttataaatatgagaaatacaaaagctagctgcctgggattctaactgcaggagtgattagccccagatagttcatttcagtcccaaagacatcactgaattaaaggaatgggataatagcagatgacccaaaaccccagaagcagtttatacaagtacccagcgtgctgggggcctccatttgtccttccagacccactccccatccttctctaccttgtagggtgactctgaggtcacctgcttcaactagcttcgtggctctctggctttgattgggttgggtttggccaataaagagaactgacagatcagagaaaaagaagacacagaagttggggtatatattctcccagctccccttctgtggggtcacagtgggctggctgtgccccttagctgaaggtccagctctcaagtggtcctcttcatgcagctctctctctccacggttccagtaatctctccctcccttgaactatcttttgcaattcctcgcctcctgtccatatctttgaaaatggtgcccttactaagctcctctccaattactcagtttgagtgtgacttctgggtcctgctggggctctgactgatacgactcatgagacaagtttactgataatgacagagcagaagcattgccatcttggacaagaactgccattttaagttcaccttgaccaaaaattgcctaaatccaaagggcatcagcctaatgggtacagtcagcataaccataaatcacagataacatctccaatcagaaacattccaaacccctccccaaccagagacgtgcaagccccaagataacctcccctccagccagagagatgtcaaccccaagataacctcccctccaactagagacattccaatcccaccataaacttctcccccacacagaaacattccaaactctctcaccaataaatactctcagtctgtaagagagagagtgttcctgaccgaaatcggccagaagcccctctcaggtttacttctccaaaataaatctgtctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgacttttttaagatcacatgctaatatagaaggaacacaaactcagaccttttgatctcttgcaaaatgtcttctatcatgtcacttaggttttcaccaaaaaatagttttcagaatttctatgcttaactaggtcagttatagctaaatggaaaatgcaactatgtaaactaagtcattaaccaacaatattgttgggaaacaaattgttctcaacaataatggaaaatatactgtgcaattaaaaatatattgtacacacatatatatatatttttaaagtcatagctattcctattaaccaagtaaaagtgacttcattcagtctgcaaactttcatcttacctcctttgcagatgctagggtaaaaacaatcaggaaacacgattccagcctgatacgcatcctggtgttctagtaacagctgcagagcaagaaaatacagagattaaggggcaggagtcaacagcctggggagtataggccccaccaattttctgtgatgagatgctagaaatatgggggtatagatggaatgaaagggaaaaaggaaggaaagcaggcataaagtaaataaatgattaaaattcacacataatccaagacaaaacacaacaatatataacttcagattcttccctaccaaacacagagaggctaatttagaaacagcagaaaacacttgtttaaatttcatcttctttcattttctctgtcaatccagtaaagcaggatttccctgaggccttaaggttgttttactgacccagagctgttgtttttgttgctgttgttgtttgtttgtgttttgagatggagttttgctcttttcacccaggctggagtgcagtggcgcaatctcagctcactgcaacctcccaggttcaagcgattctcctgcctcagcctcccaatgtgctgggattacaggcatgagccaccatacctggcccacagctggttttttataaaattttcaatgattcacagtgaaaagagaaaaacggacacacaaacgcacgtacgcacgcacacaaacaagcacgcacatatgtgcatatcagtttatagttgctacctgtgttttagtgtaagatgacgtcctttgtgttttgggagggctaaaaaaagtgctttccctttttaaatgatgtgaaagtagatggtagcggttttcttctaaatgttcttccttggtcaactggctcacttccttccattccgagtcccttatgggatgtctagctgcatgctataggctagaaaacacagactacatttcccaggctgtctcagctcacagtctgatatggcccagcctccaccacggagccctcggctaacatggaagcatttggtttttccacagcagaggtagcacagcccctcgtgttgcagctctggcttcccacgtgtttatgggcagagtacaggacaaccatattgttagtaaggcaggtgcccgaggtggtgatgaggtcccagaaccaataggtgaggtggtggcttcttattttacaaaccgtgtatgagaccgttgaatttgtagcaaatggggcagtgaatgcctgtcaatggcaggagtagcagctccttgacaggccagttctgtgcattattttgggagtcctttctggacacctggcctagagcctgctcctgcagttcccacagtttgtaagcagtgaattctctaattcctggtattaatcctttccttgcctaaactagcagaggggtttccattatctgcaaatgaactctgatggacacactgggcaaagtaaaagtttggcaatatcccgcccttttttttttttttttaaataagaacttactaataatgtggaccatatataggtgcaacaaagaagtacttcaagaaattaaaacacaaagaaagatagtatcatctggtttttggttttgtttttctaaccagtatcccattctcctccttctagaggcagaatcaccctctcccgaggagagcccattccacaccgctcaggtggggctgaccagaatgctgtggccagcatgcccaccctcaccacagagtttggctcagaaatggacctttgagcaaagctagttccgttcacaccttccccaagacttctccactagagctctgggaagatgccctcttccccttgtggctgctgagctctgacgctgagtgctaggctgtcagcattccccacgtggagagatatagaaaccatctagagctctgggcccagttccacactgcagatatcagttacatgaaccaataaagtccacttttttccaaaagatagcttgagttggacttttttcacttaaaaatagtaattaactttactggctatttacttaaccagtcactgttctaagctccttatatgtattaagacttgttgaatctgcatctcccagtgaggtaggcatgttatttaatgtgataaaataatctgaagtaaattttaaaaattatgccaaagagcaaactgttgaggaaaaaagaagagtactaacgaaggatgtatccttcagatattaaaatgtatttttggatttttttttttttttttttttgagatggagtctcacactgtcaccgggctggagtgcagtggcgtgatctcagctcactgtaacctctgccttccgggttcaagcaattcttcctgcctcggccttctgagtagctgggattacaggcactggcctccacacctggctaatttttgtattttttttctttttttcttttttgagacagaatctcgctctgtcacccaggctagagtgcaatggcatgatctcggctcactgcaacctctacctcccaggttcaagtgattctcctgcctcagcctcctgagtagctgggattacaggcaccggtcaccacgcccagctaatttttgtatttttagtagagacagggtttcaccaggttggccaggctggtcttaaactcctgacctcaggtgatccacctgccttggccttccagagtactggatttacagacatgagccactgcgcccagataatttttgtattctttagtagagacaaggttttgccatgttggccaggctggtcttgaactcccgacctcaggtgatctgccaaaaacatatttttggctgggcaaggtggtgcacacctgtaattccagcactttgggaggatgaggtcagcggatctcttcagcccaggagttcaagaccagcctgggtgacatggcaagactctgtttctacaaaaaatttaaaaattagccaaacatggtggtgcagctacttgggaggctgaggtgggaggatcaattgagtataggaggttgaggatgcagtgagccatgatcacaccagtacactccagcctgggtgacacagtgagaccctatctcaaaaaaaatacatatttttaagctatagaaacaaaacaaaaatagtatgatactgaaaccaaaaggaacagatcaatgaaacagaataaagaatacagaaaggctgcacgcagcagcttatgcctgttatcccagcactttgggaggctgacgcgggcggatcactcgaggtcaggagtttaagatcagcctaggaaacatggtgaaacttccactctactgaaaatacaaaaattagtggggcatggtggtgcctgcctgtaatcccagctactcaggaggctgagtcacaagaataatttgagcctgggaggtggaggttgcagtgagctgagatcatgccactgcattccagtcttaaaatatatatattttaagctacagaaacaaaagtactatgatactgaaaccaaaagaaacagaccagtgaaatagaataaagagtacagaaaggccaggtgcagtggctcacccctattatcccagcacgttgggaggctgcggcgggtggatcacttgaggtcaggagtttgagaccagcctgggaaacatggtgaaactgcgactctactgaaaatataaaaattagccgggcatggtggtgcacgcctgtattcccagctaccaggaggctgaggcaggagaatcgcttgaacctgggaggtggaggtgagatcacaccactgcactccagcctgggtgacagagtgagactccatctcagcattagagaaaggagttaaagatatggacatggtgaaggctagagtaaatcttgcggtgtcggattagaattggtggtattttcatgtgaacttatggagagtctcgttctgtcacccaggctggagtacagtggtgtgatcttggctcactgcagcctctgcttccggggttcaagcgattctcctgcctcagccttccaagtagctaggattagaggcatgccccaccactttgttttgttttgttttgttttgttttgagatggagtctcactctgtctcccaggctggaatggagcgcagcagtgcgatctccgctccctgcaagctccgcctcccgggttcacgccattctcccgcctcagcctcccaagtagctgggattacaggcgcccaccacgatgcccggctaattttttgtatttttagtagagacggggtttcaccgtgttagccaggatggtcttgatctcctgacctcatgatctgcccgccttggcctcccaaagtgctgggattactgacgtgagccaccgtgcctggcccaccatttgttttttgagatgaggccttgctctgtcacctaggctggagtgcagtggtgtgatctcagctcacttcagcctctacctcccgggttcaaacgattccccgcctcagcctcccaagtagctaggactagactataggtgtctgccaccacggccagctaatttttgtatttttagtggcgacaaggtttcatcatgttggccaggctgttctcaaactcctgacctcacgtgatccacccaccttggcctcccaaagtgctgggatcacaggcatgagccatcacgcctggcctatttctgaggatgacattagtatttggattagaatgcatcctgaaagggagcgtctgtgtccatttaacatgttttaaattaataatacctctactagaataccttgtagaatacctctactagaaatcactctgcacacactctggattgattgttcatgtgatgaattaggcagattctcgtttccactcctctttcctgcctacttgccgtcaaggtcaatgaagatgactatcagatataaatgctgtttttcctcattcggcctgttaggttggcaagtgaggaagctgaatcttacgactaaaagtattttgagggtacaataaatttcagttatcttaccatcccgcttcccaaatggattatgaagacttaatgttattaaatgatccaattctgatgtcagaagggaatgctaaccacttatcaaatataagtatgaaagaattacaccttcgtcacaaagtattatttagccatagaacaaatagtgcatatgatcagaatgtgttcatttgaagatgggtaaaggtgagtcatgagctagtcctaccaggatatggaatatagcaggagttggatgaagaatctctggagaatctcagtgcgtatttcttaataaatacttccttctcctcctggtgatgcaatttgtgctcaacacacagtaacaagaagtggaaaataaatgatctctctcaagtatgactttttaaaataaaaacaaaaaagatgggccaggcatagtggctcatgcctataatcccagtgctttgggaggccaaggtggaaggattgcttgagcccaggagttcaagaccagcttgggcaacatagcgagacccccatctctacaataaaaacaaaaagatgtgttcttctcagcagcacatatactaatattggaatgatacagagaagattagcacatttttaaaaatgtactgtttaaaaaatttctcaagtattttttcaaattatgagtcatatcattaaaatctttaaattttaagtgtgatatatataagatacctataaaatgttcaagtagcacttggaagagacatataccttttaaccataatattaatgtcttataacattaataacataatatacaacattataacataaagaaataaataatgagtctcttttttttttttgagacggagtttcactcttgttgcccaggctgaagtgcagtggtgcaatctcagctcaccacaacctccacctcctgggttcaagccattctcctgcctcagcctcccgaataactgggattacgggcatgcaccaccacgcccggctaattttggatttttagtggagatggggtttctccatattagtcaggctggtctcgaactcctgacctcaagtgatccacctgcctcagcctcccaaagtgctgggattacaggcatgagccaccacgcccagccaaaatgagtcttaaaattactgtttaaatatctgttaggatctttgtttggcacctataaaagaaaactaatgcacaaagaagaaaagaaaaatcaagatttctacctctctgtagttaacacgcccattgtgaagctgaagaaactccagagctctgtgtcctgagagaaataaatacataaatcaattaagttcaactattactgaaaacataacttaggcgagatgattttaaaagaaaaatacacaatttgtggttataactgtcaaggacgcaggaaatgaaatgagtttgcactcactggcaattttcattaggtataggcttgtgcagtatttctattgttatagtacaaagcaagtttagatggtgatttaaagtttctgcttaactattaaataactctatgagctttagtgctattcaacctctctagacctcagttccctcctatggaaaagagtttaaaaaatacccaccgtataggttggttgaaataataaatgctaagtgacaagcacagtggctgacacttggtaggagctcaagaaaaagaaactgccagaccacacatggtggctcacacctgtaatccaagaactttgggaggccgaggagggcggatcacctgaggtcaggaattcaagaccagcctgatcaacatggagaaaccccgtctctactaaaaatacaaaaaattagccaggcatggtggcgcatgcctgtaatcccagctacttgggaggctgaggcaggggaatcacttgaacccaggaggcagaggttgtagtgagccgagaccacgccactgcactccagcctgggcaacagagcgaggctctgtctcaaaaaaaaaaagaaactgtcatcatattttgcttcagtactgaggcagacaaacctaagtacaaaatacaatataacacctaacctatggactgaaccaatgatcctcaaaagtttttcatcattggaccagaaggacaaaatcatctcagaaagctaccaactacaccccacacccacccacagcctgaatctcccaagaatcaataagaggactaacattccctgggaagtgacattcaaaggtgataccttatttctgttgtgaatcacctccaatttttaaaattcatataacaaaaaactattgccactactataagcattaatatcataaaagtcacaacccacaaatacaaataacctgtgtacaggattccagtgatttacgctgaatgaagccatttctaattaactcactcagataatgctgaccttccactcaggcccctttataagaaatgaaaaagtgaaccaaaatatttataaaatcatctaatttattagtaaataaatgatggagttttggtcttcttctatgtaaaaaaattctcagaatccgtgcagattctatttcaggagatgccttcaattatgttcacataaatattattctttaaatgtccattaggacctttgtttggtacttaatgaagaagggcaagcaattatctggttttattaaaatttcagatgcaatctgtcttgtaaatttttaaacactaaggattaaaaatggagtatttccatttatatttgttcctcatcagcttactctgtagttttggcaatttcaacttcacagaacatagaactgcaagacactttagaattctttaagaagttcaaccccctcattttatagaattgagaggtaggtaaaaagtgaattgctcagaatcacacatctactttactggatggctggaactagaacctaagtctgatcctcttttccattgtttcctgactcccttctagcagtacatttttaatggaaagaacgccggaccagctgtcaggacatgtaattctaggccaggccactgaaaacttagctgtaaaactgtctagtatcagtttcttcatctgtaaaagaagagaactggactcggtgacttctagtgtcctttcagatagtcaaattctgtgataacaggttcttgcccatcgtagctcagtatatatgtctattttgcactgataaattttcattttttgcctataatcttattattctttgaaacttctggaggtggtacaactataaaattctgttataatttttatctaaattaaagaaaactcaggccaggcgcgatggctcacgcctgtaatcccagcactttgggaggccgaggcaggcggatcgcaaggtcaggagatcgagatcatcctggctaacatggtgaaaccccatctctactaaaaaaaaatacaaaaaaattagccaggcgtggtggcgggcacctgtagtcccagctactcgggaggttgaggcaggagaatggtgtgaacccaggaggcggagcttgcagtgagccgagattgcgccactgcactccagcatggcggacagagcgagactccgtctcaaaaaaaaaaaaaagaaaactcagaacatcaggtatatctgaaattaatctgaaaattgctgtagaatgttatcacagctaattctattacaaattgactcacgttttccatgcgttaaaacatgttacaaatacacttcatacaagaaccaaatccttttgctaagaaagatcttaagtgttctcagcccatatgcaaaaaacatggtagctatgtggggggggcggatgtgttaattagcttgattgtgctaatcatttcacaaggcatacatatatcaacacatcatgttgtatatcttaaatttatacaatttttgtcaattatacatcaataaagctagaaaaataaaaattttaaataactctttgtggtgccatctccctatatccaggatgactctgcccttgcccctaaggtcggtggcactggcttgctgtacccttctgctctccaactcctgccatcttcctggcaccgtgcatgtggataactaaactcccttactttcttgaccttcctgaagccaagcacttttacagcaatttgactcagggacccactcccatggccacatatggctctttacatatacttggaaatgcctgtccttggacatgtaaaaacaacaaaagtacatttctcactcctgccatattccacccatcttgttcctctcccattctgtcagttctgctgccacgttgcaacctctcgttcactgagcctctcactatttccccacccagagaaacacacaggggtcccatgaccaatggggcatcagctctctttcttatttgccccttaactgaagtcatgctgccaatccctatccctggatgactgcaatcaccggcttctcctccctgctgtcaggccactcagctcagtgcccaggggaaactgtatcaatccacgagcgggattttcagtctcttccttaatgtctttgacagatgtattgtcctctcaacaacataacaagacaccagtacttacctatttctacgtgtgttgaaaggccacacggtgaacctctatggcagagagaacccaacatgatcagcaggccaggccacaacctgaaagcagacatgatctcattgcccaccggcttctctggtgacgtgggaatgctcagagctgcagcagcactgggactccaaaatccaggtgcagacccaccgcttctctctaagcaggtcactgaccgaggaaaccaagcctcatttcaaaataatatcgttttccaatgaagtcaactgtccaactactgtttagcttcaccagaacagcaaacaaactctgtgctcctggggggtggggttgggaggataaactgaaatctgaaaagccttaggccagaagcactgcatcttctgaccgaggttttttctggatttcattttaacatgaaatttgtgtagagatgcaagcaaagttgtctccagatattttttgctttctataaaaaggctcacctgtgcagatagtcaacatattagaccacctcaccttacaagggtggatctctcatgcatcctttctacacatttatcaggctgtcctgcttcctccgcctcccaagccacaagtgctgggaaagttttatggtaatcagctggaactggcttccttttcagtatttggcaacagatactgacacttgtatgggattacacaagagcagccactcctggtctctctacctctggctgttctaatagggcttatccagagcctgttgcaaggtcagattcctgcagctgaagcaaagatgtcaattccacttgggaggtggaaggaagggggcagatttagggccaagaaacagggtttggaaaatgttaagctcacgatatattatcaggtacccacttacacttcatccatgggaaaaattaagctcttcatgaaactgatggtaatcttaaaacacaaattatgcatattttacattaaaagcaagagatgggctcctaaaagagtgggaggaaatagtattcacttcaggtttgccaaatgaaaggatgaatagaaagtgggatgatttggctgggcgtggcggcccacacctgtaatcccagcactctgggaggctgaggctggtggatcacctgaggtcaggagtttgagaccagcgtgatcaacatagtgaagaccccgtctctactaaaaatacaaaaattagccaggtgtggtggcacgtgactgtagtcccagctactggggaggctgaggtgggaggatctcttgaacccaggaggtggagattgcggtgagccgagattgcaccactgcactctagcctgggtgacagagcaagaccctgtctcaaaaaaaaaaaaagaaaagaaaaaaagaaagtggaatgatttgacaacagttgtcgccccaacagtttcccctgtaagcttaacacagccatgtgcacagccccaaggaaagaaatcccgcagctacccccagacctgaggggcagtaggcccagctactcctgattagtccagaggccatatgcctacgtgttttgtttggctaacaggatgttttataaacttaaatcaagtttatgaactttttctaaatgagaaaattcacgtagaaatctagatttctggctctcttaaaaacaaaagaactggcatcatgaactgacgctcccatgtgacacgacaaccagctgcagccaaagagccagctgccccctgatagagcatgtcctgctcctccagtccccaccatccatgcaatgtgtgcaggtttccacaccccttctggccaccagaggcctttgagtttgcctccctgtcactctgggccttctacagactgtgcgtgagggagtcacaattattaattgggactttggatattgtctctcagaacatccaagagcagtcaatcaatggttacaggggaaaaaaatactgctagaaaagatatctaaccatatataatacaacaaacccatccaaaaagcaccaaagaaatgggttcagaacaggtgtggtggctcacgcctataatcccagcactttaggaggccaaggcgggcagatggcttgaggccaggagttcaaaaccagcctgtgcaacatggcaaaatcccgtctctaccaagaaaaaaacaaaaacaaaaattagccgggcatggtggcatgcacttatggtccaagctactcaggaggctgaggcgggaacatcgcctgtacctgggaagtgaaggttgcagtgagctgagatcacaccactgcactccagcctgggcaagaccccacctcaaaaaaaaaaaaggaatgggttcagttaccaaacaatactaatcccaaatgtctcaatttctcattatgcatttttttgtatttgagattcagaatgacataaacgtataaatgtaataaaataagaggaaattatttgcttagtgtgatagttatgaatatggtctttatatgacaatattgcttgcagttttatgaagtttgtattactttggtaacaataaaaacatcaaagatatgactttaaagaaagttaaaacgtagctcacaatattactatctgacaaataataagcatatggaaatatttttctttctgccccacacccccctttcctaatataggtggctttgttataaacaagacagcatgattctaccatttagaactcttctggaaatagagacccaaggtgaaaagtaaacatacagttacattaaggagtgagtagggagaatacaggtttgaaagccagagggtctcaagctttatgtgggccagtctagaaaatgggggagaagaggctgggcacagtgtctcatgcctgtaatcccagcactttgggaggccgaggtgggcagatcacctgaggtcaggagttcaagaccagcctggccaacatggtgaaaccccatctctactaaacaatacaaaaattagccaggcatggtggcgcgcacctgtactcccagctactctggaggctgaggcaggagaatcacttgaacccaggaggcagacgttgcaatgagctgagatcgtgccattgcactccagcctgggcgacagagtaagaccctgactcaaaaaaaaaaaaaaaaaaaaaagtgaaagaaaaaaaagaaaaagaaaatgggggagaggatgaataagggtgggaactggggagtggaggttcccaggacaagggcagccaaaggagaaaggagggaagaggtccctctcacctgatggtcttgtccttgtaggccctggtaaggacagacacccagccaggcgctagggggcatcaggacaggctggaagtaagacaggagccaggaggaaattgtttacactctgaatgggggcttgaagaggggcacaaaactgagggaaaaggggagggccacattgtgaactttctaagctccaggcgcttttgcctttgtgaagtacttcctgtcacaaaaataagtaaacaataaatagaaatcacattttacatctgcattggtgtaagattaacatattaatatgccacctaaaacttcttttcttcagattttagaataaattaaacatttgtgagtgctcctaaaagttttatgggcccttggcatcgtacctactgtgcgtaatggataagtcatctgggaaagggagtgggtaccgtttgaaatagaaccttaaaaaggtaagtgggctagggtaatttttgaacaagagaggcagccacaattaacttggcttttctgggcctcagttgattgaggcctcaattgaatgatttccccaggccagtagaaatgagccctgtaatcccagcactttgggaggccaaggagggcggataacttgaggtcaggcattcaagaccagcctggccaacacggtgaaaacctgtctctactaaaaatacaaaaattagctgggcttggtggcacacacctgtagccccatctactcgggaggctgaggcaggagaatcgcttgaacccgggaggcggaagttgcagggagctgaaatcgcaccactgcactccaccctgggtgacagaatgagtctgtcggtctcacaagaacaaaacaaacaaaaaacaaaaaccaccaccaaaaacaaaacaaaacaaaaacaaaaactccctccgcaggcaggagatgtaaacacgccagctccccagccccacctgtgatacctactggcccacatccctattaggactccctggttctccccagttcctgcaataaaatacagagcaaaatagtgtgaaattgattaaactctactgttatcacttctgccatatgtgactggctcaaaactcaatggatctgactcagcaaaagacaaagtcaaaatttaaagttactgcctcggcattttgcaaatgtcctagaaaaaaattcaacgtcctagaaaaaggtgaaagctagcaagatactctcaacgctgtaggagttgagaaagggagatatgtaacctaaaatcaatgcatagggctgggcttcatttgcacccacaaattcccagcatacgcctgctatttttatttttatcctcattaggttttaagcttccctgctgctttcagagtcttaagcccaagtctaattttttaacggatgaagaatgctgtttaaaggtgctcaaataccttggttggatagtatgctcaatccttataccttggttgattcaattttgacaaatgcttccatttactagttggtgacccaactttaatcttactagtggcttgactagggtagctagtatgactttgaacgctatattgaatttaatgtggcaactgtaatgagcattttacgttatctcacaacaaaatggggtagatatggttctattttataagtgactggactaaggttaacctgtcggtcacacagcttgtcggcaacagacttgagtttggatcctagtctgtttatttccaaagcgctgttatttatcgggagcaaccctaggagaatgcctagacacacacccaaaaaagcagccaggcagcagaacgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcaggagcagttagtgacaaatgagcacccgaaaagtgaaaaggtgacagcagtccgcaggtgcatctactggcgagccttctccatccccgaacccaaccctcccccgggagaaggtcgcgccaggagagaagccgcgcggcgcttagggcaaggtgcagagggcggcgcggcggtgcagcgagaaagacgcggagagagggcgctgctctgtggctctgcaaccttccgccagctcccacgctttccccgcgcgtccccggcgcctcctcgctcctcttgcttccccgcgacccctgcgttcccgtgcgcgcgcgcccgcttgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggtgagagagcccggatgcagggggccagagctggccggggacacggcggggagcagagggggctttaccccaaagtgacaccagccgcgtcgcctccctcctgtgctcagttccccagggtatacaaagtggaaagtcagagcaacaagggagacgaccgacaaataagtttggagcttccactttgagccgggcactagggacacgacccctgccctcaagcctcatcaagttatgcactgcccagtaggggaggcagaacgtgagcgcctaatacaagcgagctgcttgttatggtcaacaagcctaaccgtggaggggcggggagaaaggggaggggtgtcagggaagtgagagcacgtgtggcccttcagagtagctgaaatatctccgcagctgcagggagcccacgcaggaggctgcttcagcggcccttgagaaggctggtagtgagggcccctggccagaatcatgggatcggaaacggagagaactgtagaaagatttgggttttgtgcaggggaagagagaaatccaggagcgttctccaggttttcaccctaaatggataaatgctgctattggccattgcatagagaacactggagaattgggagtaaggggtggagggccattaaatgggaagaatagagtaagaagaaaactaagaaagtagtttcttccttctaatattatattattaaacctggagtcaacgcagtgaaattttttaccgtgtccttcaaagctctccctctgaaggaatgcatccagcgatccctacgagtacaagagagtcttagcactcattcatccatcagctgtttactgagcacctgctgtatgccctgcactgttggaggtgcttgggatacctcagttaaacgaaagaaggattctgcccttatggagctcacatggggtggaaggggagcagaagagagatcagaactctaaacaacaaacataatatctaagcaaataagtatgtgagagatgctgagtgcaatatggaaaaaaggtagaagcaggagaggatccgggccagagggaaggggcaagatgcagcatcaacagtgtgaccaggcatattcctctgctagggctgccatagcaaagtaccacagactgggtggcctgaacaacagacatttctcattttaccgctctggagggtagaaatcccagatcgaggtgttgtcagagttggtttcttctaaggcctctcattggcttgcagagagctcagcttttgtctttgtatctcatcagacctcaattttagactcatggagtctgagatgtctgttcacgcccaagtgaggatgtaaagtaagcagttggttatatgaatgaatcttccctgtgtgtctccacatggtctttcctctgtgtgtatatgtgtcctaatctcttcttcttttaaaaacaggagtcagattggattggggcccaccagaatgacctcatcataacttaattccctttttaaagaccctatttccaaatgcactcacattctgagatactggggggttaggacttcgacatgtcaattttgccaggagcaccattcagcccgtaacatcagggtaggtctcattgaggacatgagatacaaagaccaaaggaggtaagtgtgtccggagttggttcctgccggtaggtttgtggcctcgctgacttcaaaaatggagccgcggacctttgcagtgagtgttacagctcttaaagatggcatggacccaaagaatgagtggtagcaacatttattgtgaagagcaaaagaagaaagcttccacagcgcggaaggggacccgagtgggttgtcgctgctgggtgggtggggcgtggtggccagctttttattcccttatttatcccttccagtgttccgtttctgtcccatcagaatgcctttttttcaatcctccctgcgattggctacttttaggatcctgctgattggtgcgttttacagagcgctgattggtgcattttacagagcgttgattggtgtattttacaatcctcttgctagctacagagcgctgattggtgtgttttttacagagcactgattggtgcattttacaatctccttggtagctccagatcgctgattggtgcattttacaatcctcttgctagctacagggtgctgattggtgtgttttacagggcgctggttggtgcattttacaatcctcttgtaagacagaaaagttctccaagtccccactcgacccaggaagtccagctggcttcacctctcataaggacattcagctagagccaaagtagaagcatggctgacacatttgcagaacagcaaggaggcccgtgtggactgagcaaaggggaagagttgtatcagaggaggtcatagggagaaggggaagagtgggtggaacatgtaggacctgtgagttattctaaggacttggtttttactttgagtaaagagggggctgtgtcagggttttaagcagagatatgatctgatttacattttgaaaggccactctaaccacagtgctgagaatagatgaagagtggtggaagcagagagacaggttaggaggttgttgcacggatttaggtgggaggccacggtggcttgaaccagggtggtagcagtggacaaggtgaagagttatcccataaaggatgtattttgaaggtagagcccactggattttctgatggatcattatatagaaagtaggtgaaggagaggggttagtgatgactccagggcttttggcctgagcaattggaaggatgaggatagctgaattgaacagcattagggtgagatatcaagagttcagttttagacttattgagtttgagatgtcggttcacacccaagagaggatgtaaagtaagcagttgggtgtatgagtctgaggtttgagagcgaaccctaggctagaaatataaatgtgaaattcatacctgtgtgtactgcatacatacttacagctatggaaatggtgagatcacaggaaaggagtggaccagggcctgagccctggttcccctagcatcattctggagtcccacaaggccccacgaagatcaaggctgccatacaatggtgttacactgcaggggtctggaaagccttctagtctgtcagtgattgtttggcagctgcagggcgggtgttgggacctcttgctgacactagcagcattatcctgtgttcagatcacaccgcccatcctaatgtctgtgccccttgaacattacagtgatgtcagcttccatcttacaagggctaggatcttctcagggaaccttcctttttgaaaggaggggttcaggctgggcacggtggctaacgcctgtaatcccagcactttgggaggccaaggcgagtggatcacctgaggtcaggagttcgagaccagcctgtccaacatggtgaaacactgtctctactaaaaatacaaaaattggccagacacggtggctcacacttgtaatcccagcactttgggaggctaaggcaggtggatcacttgaggtcaggagttcaagtccagcctggccaacatggcgaaaccccatctctactaaaaaatacaaaaatcagctgggcgtggtggtgggcgcctgtaatcccagctactcaggaggctgagccaaggagaattgcttgaacctgggaggcggaggttgcagtgagccgagatcatgccaactgcactccagcctggtggacagagcaagactctgtctcaaaaaaaaaaaaaaaaaagaaaaaatacaaaaattagccaggcattgtggcatgcacctgtatgtaatcccagctactcaagaggctgaggcatgagaattgcttgagcccaggaggcggaggttggttgcagtgagccgagatggcgccactgtactccagcctgggtgacagagcgagactgtctcaaaaaacaaaaatgaaggtttttcttggctttgaatacacctgtgcagatgtgggaagctacagcctgagcagcgctctctttagagtgccttgatggcagcccaggtggcctagattctctaggccttcctcattttctttttttaagtggttttatgtgaatgaattaattttttttttaataagccatttcttccttttttcttttcttttttttctgagacagggtcttgctccattgcctaggctggagtacagtgatgctatcattggctcactgcagcctcaaactcataggcctaagcgattcccccacctcagccttctgagtagctgggaccacaagcatgcaccaccacacccagataatttcttttcttttttttttttttttgagacggagtctcgctctgtcacccgggctggagtgcagtggcgcagtctcggctcaactgcaacctccgcctcctaggttctcctgcctcagcctcccgagtagctgggactacaggcgcctgccaccatgcccgggtaatttttttgtatttttagtagagacggggtttcaccgtgttagccaggatggtctggatctcatgacctcatgatccgcccgcctcggcctcccgaagtgctgggattacaggcacgagccactgcgcccagccccacactcagataatttctgtgtgtgtgtgtgtagagacagatctcaccgcattgcccaagctggtgttgaactcctggccacaagcaaccctccctccttggccttccaaagtgttgtgattacgggcatgagccgccacacctggtcccataatattgttaataatccaatgtatccctttatctgttttttgttcattggaattttttaaattatggcaaaatatgcataacataacatttaccattttaaccatttttaagtgtacatttcagtggtattaagtgcattcatgttgttgtgcctgggccctcttcttaagtgtgtaaaaccctttcttatgcctcatgcatgccccagtccatatgtcagtctctgggacaaatccaggttgccagtgagccactataatagggaacaatacttgaagacactatgctgagtgaaataagccagtcacaaaagggcaaatgctgtatgattctacttaatatgaggtacctagagttgtcagattcatagagacagaaagtagaatggtccaggcatggtggctcatgattgtaatctcagcactttgggaggccaaggcaggaggatcgcttaaagccaggagtctgaggttgcagtgagctatgattgcgccactgcactccagcctgggcatcagatcaagaccgtatctaaaataataataataataataataataataataataacgtagggaactatatacctttgtatggtaaaattaaagttgttcttatttaccataagcaataatagctgtttccacaaaacttattttatcttttataatttatgacgcagtatacctctttagatgcaacttgaaattggatctctattactcatcaaagaagggtcagttagcatgagcaatatagtgagaccttgtctgtacaaaaaaaatttttttttaattagctgagcatgatcatcctgtagatcctgttagcatgaaaagtctgtatggcatgacaacaacgactttaaggggaagataagatttctttctacttctaagtgatgctgtgataccttaagcactaaggcagagctagtaatgcttttttagtttcacagatcaaagtaatcttattttaacagatcaaggtaaaatgcttattttaacagatcaaggtaatcgttgtaagatgtatataacatgatgttaacttggtagtctaagtgtttagctatcaagccggattccttagtagaccaaatcttgttatcgaagtgttcttgagctatacccttgatgtttagaaaaaaagtatttgttacctcttgtagggtctgctttttgaacttttcttcccctgtagttgccaattctgcatgtactagtcctctagaaataggttaaactgaatcaacttgatggaaggaactctccacagggcttgttttccaaagaaaagtatagtttggagaagcaaagttacaagcctacctaagcatatcataaagctgttcagaaataactcagagccagtctcgtggatggaaatgtagtgcctgagtcacattctgcttaaagttgtaacagacacagaggagttaaaaaaatagctgagcgtgatgatgtgtgcctgtggtcccagctactcagtagtaggctgagctggggggatcacttgaaccaaggaagcagaggttgcagtgaggtatgatcacaccactgcacttcagcctgggtgacagaacaaaaccctgtctcttttttaaaatttttttaaatttttgattttttttatttgtgtgcttttcattgtccaaacccagaccctgtctcaaaaacaaacaatcaaaaaacacagaagttcaatgtatgtttccccaagcatcttactcagggttgtccagaaaaatagaaccaatgttttatatatatatatatatatatgtgtgtgtgtgtgtgtgggtgtatatatatatgtgtgtgtgtgtatatatatatgtgtatgtgtgtatatatataatcatagatatgtaggaatataggaagagacttcttataaaggactggctcatgtgactgtggatgctaagaagtcccaccctctgctgtctgcaagctggagacctaagaaagctgatatgtccagtctgagttccagactgggtccaaagtcctgagtaccaggaatgacaatgtctggtgtctgacaacaggaggaaatggatgtcctagctcatgcagagagtgaatttgctcttcctctgccactttgttcttttcaggttctcagcagattggatgatacccacctgaatttttgaaggcaaatcttctttattcagtctactgattcaaatgctaatctcttccgaaaacactcacggacatacccagaaatgatgttttaccagctatctgggtctcccagtcaaatttacacataaaattaaccattacaaccaaggagaatgagaccatacagctaatattttaggatattgaattttatttagcattctgtcttacacttggcattttattacttttctgccttgttatttcttttgcaggagaggagttcattacttcggaagtggtacaatttaatgatacaaaataaggatgaccttgccagaataatcacagctgaaagtgtaagttcagggttctggcttggtgcactgagaaattctccaggaatttttacactaaacttgggaaagccgctgacttcccttcactgctggctgtagctgaagaatatgtgattccttctctactgatcaaataccaaatcattattgtgccagggtacttagatttgctaaaataatatttgtatgttctagtttattctttaatagtatccaaaaatagattttgtttgcaactatatgaataactgctgtttcaccattctgatttttttccatgttactgttttggttgtttttttttttaaacttgtttttgtacattttttaatgtaccaatacttcttccatagatataataaattatttcatatcgtggttacaatacttagaagatattgaaaggaggaaaaaattagatgtttcctaatttgtaaacatattgagaatgcaatgacttgtggtttagggtgatacattcatcattgtaattctgctttttaaaactcacaccaaagtcagaaattttccccactctatgggtatcgttataggagacttttctactcttgttgcatcttgaagaatttaggaacacagagccatgcttttattattagaaggtaatacgtgggttcttttctgatttaatttagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccggtaggtgacaggatcagcaagatcctagggtgggagattggatagggagttgggaaacaattcattcttcctcgtgagcaggtgtgctcatcctgttagttttgtcacctgttcctggtttcctgatgcttttgctggatgtggaagtgtgtttcctagtcctctgtgatgatgttaggtgtggtggcagtgagtggaatgatgcatttctaatgcctgcaaaagtgggatgagccgcaggaggacccaggggctcttctgacttggcatggaggcttcttcctggcattgcctagcacctctgaaaagatcttccagtatttatcatttttaaaaagacttaagatatgatacatttttaaacttgccatagtttggaaaaaagtgttatgcttaattgatggttatcatcaataacaaagcatttgtggacccactagcaggcactgggccaggttctagaggtaaaaaggctaagaaataaggtatcacatctgcctggatggggctgcagtatatttgtggaacgcccagctttccttctgggtcctgccttctactaggtcccatattaacctctctcctgtatctgtcagctggtctcgagacgtctgtgtttttcctgctcagcatagttacagacagaatccccctgattgcctagactggctaggtttgacttgaaggtcactatttactaaatgtgcaaccttggccaaattacttaactgcactgtctccgttttcttgaacttgcaaatgaggttaatatcaacctcattgggttgtgataaggatttaattaattttaattttgaagtacttagaaaaatacctgatacagagtaagtactatataatagagtttttcaaaataaaataaaatactgttattataggtatatgtataggcatttataaatatgtatgtggaaggaataataaatcatctgccattttcaaaaccattgctaatacttactcccatgggcctcaggccaaatccagcccactgcctatgtttgtaaataaagttttattgggacacagccacacccattcatacacctactatctgtggctgttttcacaatacagctgcagagttgagtaattgccatagaaaccatacattctacaaagcctaaaaaatttacgatctggcccttcacagaaaaagttggctgacccctggtctaactaattttttactgtgttaaattctaaaaatatttcctgtcttcaagagcctttatctcagagtccctcaagttggcgggggggtcaggtgttctgagagctcacctgtgcagccaaacgggtttgtcaatcagttgtgcaatgaaatttgttcactgacttcccaacatgccttcctttgcactaaggaggtggtccttcctctcacatacttcctctgctcttctaaccccagtggaatttccccagtgccatgatcacccggaaggtgggggccgccctggcagccggctgtactgtcgtggtgaagcctgccgaagacacgcccttctccgccctggccctggctgaggtgagccgctctccctgtgtttgtacaaagcagacaaagttcaaaaattgatgtttatctgggacagaaagaagcaattttggagcctacttctttgcttacgcctcctgatgcatggtgttgtgtattaatctactggtgattactttaagtcagctgtagctcttttgggaaaaaaatggatgagggatcttctgacatctgcaggccatatgttttcagcctactgtaaaatggtatctatccatcatcttcataaactaggcacttaaacatgggtgtttctcacatttaggaaacttcttatttcccattcccattcccagttcaatctgcattccattagatcttattcttttgtttgaaaacctcaagtggcctcttgtgtcactcactcagagtaaagtccagattccttagtggctttcaaggtcctatgtcacttcccacccccccagtatgtctctgacttcgtccatcacactggaacccctcactcttcattcatctgcttggaccactctggcccctgccgctttccagaccccgccagccttgccctccactcaaactttatactttccctctgtctggagcagtctcccccagatacccctataacttgcttcttcacgtcttcactcaaattcctctctcccagggaggccttccatggccaccctgtctaaaaatcacaatttggctgggcgtggtggctcacacttgtaatctcagaactatgggaggccaaggtgggcaaatcacttgaggtcaggagttcgagaccagcctgaccaacatgctgaaaccctgtctctactaaaaatacaaaattagctgggcgtggtggcatgtgcatgtaatcccagctactcaagaggctgaggcaggagaatcgcttgaaccctgggggcggagattgcagtgagccgagatggtgtcactgaactccagcctgggcaacagagtgagactcagtctcaaaaaaaaaaatcacaacctcacactctgatcctcctgatcccctcctctgctttgctttttcccccagaacacctaaaactacctaccctatcactatttgtaggccttttcagtgggcagggctaggagatatacatatatgtgtacacatgtgtacacacacaataaaatgctgcagaaattcctatagaaacttcgaattcaaattcagtcctatagagtttttacttaatttattttatattatatctgcacctccttctttcctggttccttttttttttttttttttttttttttttttgagacagtctcgctctgtcacccaggctggagtgcagggtcgcaatcttggctcactgcaacctctgcctcccaggttcaagcaattttctgcctcagcctcccgagtagctgggattacagatgcccgtcaccacacccagctaatttttgtattttttggagagactgggtttcaccatcttggccagactggtcttgaactcctgacctcgtgatccacccgcctcggcctcccaaagtgctgggattacaggcatgagccaccacgctcggcctctttcctggtttctaaagactcaggaaatgactgaattaatattctgtatgtactcattatacagaacaacagcttctgaatatcaattttatttgttttaaatattaattttaatatcaccaatgtgcctattgaaaatggtttacttttttggtattttctctttccattctcatttttagtaataaacttttattttagaatagttttacatttacagaaaaattgcatagatgggctatttcccacataccccacattcaatttctcctattactagcagcttacattagtatatttgttacaattaatgaatcaatagtgatacgttgttattaactaaagtccatactttaaaatccattctcagattttattagtctgtacctagtctcctttttctgtttcaggatctggtccaggatatcccattacatttagttgccttgtctccttaatccctcttggctatgaacatttgtctgtattttaaaatagttatactgtatctgtgttgccaaaactacaaccattacatgctctactctctccagtttaaccctcctttagacttagttgaacaagcagttgtatgtttatgcttaccaccagtgcttatgttaatgtctctctggacatttggtgatccgaacctcagtctgtagtagattccttaggaatattttcccttcttaaatgttgacagtagtctgggcctatcgtgcttataaatcagttttgctaggtataaaatccttggctcacatttttttttttttacttgattatcttaaatgtattctctattttcttctgatataaagcattgctcttgaaaattcagatggtaacctaagtttcttgcccttataagtcaacttttttttttacctagatacacaaaagtgtttggtttggtttttttccccctttatctttaaagaccaataatgtcactagaatatgtctttgtgatgattgctttgagtccatactctaggtatgcagtgtgctctttcagtatgtagtttccagactttttgttttatatctctataaagttttcaggatttgttcctcaccattggtttggttttactcccttaggaactcctgatatccatgagttgaatcttttttgtcactttctcttgtatctttttcatcttttccctaatttttaaaattatcttttatttctgggtgtaaaatgtctgattttatttttattttttaatttttatttccataggttattggggaacaggtggtatttggttacatgattaagttctttagtggtgatttgtgagattttggtgcatccatcacctgagcagtatatactgcacacaatttgtagtcttttatcccttgcccccttcctaccctttctccctgagtccccaaagtccactgtgtcattcttatgcctttgcttcctcacagcttagctcccacttatgagtgagaacatatgatgtttagttttccattcctgagttacttaacttagaataatactctccaggccaggcgcggtggctcacgcctgtaatcccagcactttgagaggctgaggcgggcagatcacaagctcaagagattgagaccatcctggccaacatagtgaaaccccgtctctactaaaaatacaaaaattagctgggcatggtggcacgcacctgtagtccctgctacttgggaggctgaggcaggagaatcacttggactgagaggcagaggttgcagtgagccaagatcatgccaccgtactccagccaggtgacagagcaagactccatctccaaaaaaaaaaaaaaaaaaaaaaaaaaagattaatagtctctaatcctctaatctcatccagcccactgcaaatgccattaattcattcctttttatggctgagtagtattccatcctatgtataaaccacataggatacagtttatccacttgttgattgatgggcatttgggtttgttccatgcttttgcaattgtgaattgtgctgctataaacgtgcatgtgcaagtatcttttctgtataatgacttcttttcctctgggtagatacccagtagtggggttgctggatcaaatggtagttctacttttagttctctaaggaatctccacactgttttccatagtggttgtactagtttacattcccaccagcaatgtagaaatgttccctgttcaccacatccacactgacatctattattttttaatttttttactatgaccaaccttgcaggagtaaggtggtattgcattgtggttttgatttgcatttccttgatcattagtgatgttgagcattttttcatatgtttgtgggccatttgtatatcttcttttgagaattgtctattatgttcttagcccactttttgatgggagtgttttctttgttgttaatttgtttgagtttgttgtagattctggatattagtcctttgtcagatgtatagattgtgaagactttctcctgctctgtgggttgtctgtttactctgctgactgttccttttgccatgcaaaagctctttagtttatttaagtcccagctatttatctttgttttagttgcatttgcttttgggttcttggtcatgaaatccttgcctaggccaatggctagaagggtttttccaatgttatcttctagaatttttatagtttcaggtcttagatttaagttcttgattcatcttgagtttattttgtataaggtgagcgatgaggatccagttttattttcccacatgtggcttgccaattatcccagcaccatttgttgagggaggattccctctttctctatcttgtggaatagtgtcaataggattgataccaattcttctttgaatgtctggtagaattctgctgtgaatctgtctggtcctgaactttttttggttggtaattattttactaccatttcagtctgttcgggatatctcgttcttcctgatttaagctaggagggctgtatatttccaggaatttatccatctcctctcggttttctagtttatgtgtgtaaaggtgttcagagtagccttgaatgatcttttgtacttctgtggtgtcagttgtaatatctcccatttcatttctaattgagattatttggattttctctcttctcttctaatggtctatcaattttatcttttcaaagaaccagctttttgtatcatttatattttgtatttttgtttatttctatttcatttagttctgctctgatcttggttatttcctttcttctgctgggtttgggtttggtttgttcttgtttctctagttctttgaggtgggaccttagattatttatttatgctctttcagactttttgatgtaagcatttagggccatgaacttggctcttggcaccacctttgctgtatcccagaggttttgatatgttgtatcactgttgtcattcagttcaaataattttttaatttccatcttgattccatttttgacctaatgatcattcaggagcaagttatttaatttctatgtatttgcatggttttgaaggttccttttggagttgatttccagctttattccactgtggtctgagagagtgcttgatataatttcaattttcttaaatttattgaggctcattttgtggcctatcatatggtctatcttggagaaagttccatgcactaataaatagaatgtatattctgcagctattggataatgttctgtaaatatctgctaagtccatttgttccagggtgtagtttaaatctagtgtttctttgttaactttctgtcttgatgacctgtctagtgctgtcaatggagtattgaaatcccccattattattgtgttgctgtctatctcatttcttaggtctaatagtaatcattttagaaatttgggagctccagtgttacatgcatatatatttaggattgtgatattttcctgttgaacgaggccttttatcaatatataatgtccctctctgtcttttttaactgctgttgctttaaagtttgttttgtctaatataagaatagctactcctgctcacttttggtgtccatttgattggaatgcctttttccacccctttaccttaagtttctgtgagtccttatgtattaggtgggtctcttaaaggcaacagaaagttggttggtgaactctcatccattctgcaattctgtatcttttaagtggagtatttaaggcatttacattcaatgtttgtattgagatgtgaggtactattccagtcatcatgctatttgttgcctgaatacttttgggttttgttttgttttgttttttaattgtatttttgttttataggtcctgtgagatttatgctttaaagaggttctgttttgatgtgtttccaggatttgtttcaagatttggagctccttttatcagttcttgtagtgttggtttggtagtggcgaattctctcagcatgtgtttgtctgaaaaagactgtatcttttcttcataaatgcagcttagtttctctggatacaaaattcttggctgataattgctttgtttgaggaggctgaagatagggccccagtcccttctagtttgtagggtttctgctgagaaatctgctaatctgataggttttcctttataggttacctggtgcttttgcctcacagcccttaagactctttccttcgtctgaacttcaggtaacctgatgacagcgtgcctaggggatgatctttttgtgatgaatttcccaggtgttctttgtgcttcttgtatttggatgtctaggtctctagcaaggctggagaagttttcctcgattattcccccaaatatgttttccaaacttttagaattctcttcttcctcaggaacacgtattattcttaggtttggttgtttaacataatcccagacttcttggaagctttgttcatattttcttatgcttttttctttgtctttgttgattgggttaatttgaaaaccttgtctttgagctttgacgttctttcttctgcttgttcaattctattgctgaggctttccagaacattttgcatttctataagtgcacccattgtttcctggagttttgattgttttttatttatgctatctatttcattgaaaacttctccccttatttcttgtatctttttttttttttttgtgacttccttaaattgggcttcgcctttctttgttgcctccctgattagcttaataaataactatctgaattctttttcaggtaaatcagggatttcttcttgatttggatccattgttggtgagctcatgtgatttttggggggtgttaaagaatcttgttttttcatattatcagagttggctttctggtttcttcttattggggtaggctctgtcagagggaaggtctagggctgaaggctgttgttcagattcttttgtcccacgggatgttcccttgatgtagtagctcccccttttcctagggatgtggcttcctgagagccgagctgtagtgattgttatctgtcttctggatctagccacccagcaagtctaccaggctccaggctgctactgagggttgtccgcacagagtcctgtgatgtgaaccatctgtgggtctctcagccgtagataccagcacagtatttggggtgtctcccaggtcctgcaggagcaatctgcttccttcacaggatctgtatgctctcccagttttcctgatttattcctgcagtcgttctggagcaaaagttcacaatgcaagcctccacatgctgttttgtccatccgagtgggagctgcaatctagtcctgcttcccatccaccatgatctctaaaattatctttcttttcaccttcgatttttcttgaggttatgtgttgtgtttgttcatgcttgtgttccttctaatttggttttcatttctgaaatgatttacttctttcttctgattctttcctatattccttcacctcatttccaaagttttctagcctcagttcatgttggttgttcttttgtgtcttgatgtgattttcttgtcatcttttaccttgttttgaaattgtaagttacagtttgggtctggtttttaatgttgtttgttttgttttgttttgttttgtttttgagacagagtttcactcttgttgcccaggctggagtgaaatgacacagtcttggctcactgcaatctccgcctccctggttcaagcgattctccttcctcagccctccaagtagctggaattgcaggcacacaccatcatgcccgtctattttttgcatttttagtagagacggggttttgccatgttggccaggctggtctggaactcctcacctcaagtgatccacccaccttggcctcctaaaatgctgggattacaggtgtgagccaccgcacctggcccagtttgggtctgttttgtgggcatgtctttctggtatgcttttgttgtctatagggatattattctacttcttattattttttctatttttttcttttttttcttgagacagaggctggagtactgtgttgctatcacggctcactgcagcctcgacctcccaggctcaagcgtttctcctgcctcagcctcccaagtagctgggactacaggtgtgcaccaccatacccagctaattttgttttttattttttcgtagagatagggtctcactatgttgcgtagcctggtatagaacttctgggctcaagcagtcctcccacatcagcctcccaaagtgctggggttacaagcatgagccaccacacccagcctcttttcttttaacaactttttatgggatttgacctcagtgttcttgtcagaattttatttttatgtgaagttagttttctgaacttttggaagaaggcccagttaggaatatagcttcttttccttcacagtgtaccttttgcttccttgtgtatcgtgttcaaagataaggtagcttgcttcctggctggctccatccccttcccctgtttttatcagggcctcctcatctttcatcacacggctcccaggggctggactctccatgcccttcattccttattgcagcatcccatgtactcacctactattgacattgcagcatcccatgtactcacctactattgatagggcaaggccctcccacttacagctgctgttctcagaggaacagctgtggactatttggggttctctgttattgggtataccacacggcccgttgctgccccctgcttcctctcacacaggtgctgatatgacggtcaggtcttgtcaacacaggtggtatattcttacccacttgtaatttgtggtttgtggagataccttgttgtaaatgtttgttgtaattgtcttgtgaatgtctctgagatttggggtttgctgtctaattgctgttttcatgaggatattgagggagactcacaaactcatcttcccagaatctccagtcagatttatgtaataagctaattgttaatggaatccagaaattaaaataattcaggatatgtcttatccaaagggaatctctatggaaagagcatgagtgtccagatcaggtagctgtgggtttgcatgcgggttctgttactagctgtggccttggctgcattcttctctgctatgcctccctttcttcatcatccccctgggaaatcacctatggaaaggctttgcactgctgccctgcacctagtaggtgctcattaaatgccccttttcactttcccacccttgattctacaggtgaatcaagtaacttttttcttggcatctcctttgatttttctcagggcagaaattcaggtttttttatttgcttctttattagtttgaacagaccgtggcattgaaatgcatgctctggccaggcccggtggctcacaactgtaatccaaacactttgggaggctgaggtgggcggatcacttgaggccaggagttcgagaccagcctggctaacatggtgaaaaccgtctctactaaaactacaaaaattagccaggcacgcacctgtaatcccagctactcggaaggcttaggcaggagaatcacttgaatctgggagacagaggttgcaatgagtggagattatgccaatgcactccagcctgggtgacagagcaagactgtcttaaaaaaaaaaaagaaagaaagaaacttatactctaagaattttgtttgtttgtttgtttttttgagacagggtcttgttctgttccccaggctggagtgcagtggcgcaaccttggctcactgcaacctccacctcctgggctcaagtgatcctctcaactctgcctcccaaagcgctgagattacaggcatgagccaccatgtccggtagaaattttattgtaatgatctttaacaacccattaatattaacgtgactttagcactaataagaattatatttaaacttcaaatatattcttagtctgtccccagtgtcagcttaatttttcttccattactttttgggttaagtatctatttatttctcttttctttttttttttttttttttcagtttggtaaattgttggcacatgtttgctgtttctctttatagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaaggtatgtgactcaagtttcaaagaaaacaaatgtctttctaatattttatcttgataggttataaaaatactatttcatcctgatcaccaattttggaaagatttccagcagagtgttaaaagctctgtcgcaggccaagcacggcggctcatgcctgtaattccagcactttgggatgctgaggtgggcagatcacttgaggccaggagttcgagaccagcctggccaacatgatgaaaccccctcacagaaaatacaacaattaaccaggcatggtggtgcacacccgtaatcccaggtacccaggtgactgaggcatgagaatcacttgaacccgggaggcgaaggttgcagtgagccaagattgtgccactgcactccagactgggtgacagagcagactctgtttcaaaaaaaaggtctgttggttgaataaagtaatatctgaccatcctctggggatattttggacagttctttgtggcacgacataggttcctgcttgacaaaaccaaagaaattggggcagcgagggtcccattatttttgcattatttgttgtatatgaagtgggtgaaagttctccactgtatttttttcaattctggaatgcatctttctttcaataatctagagttagagattccagaaacacacaattaatgttgaaatggatgtttttgaattgaacaaaaatgtgtttagtctaaaagtacttagagaaatggaaaggtctttttctttgagttttttttcccttaaatgatgaaatgttctttgctaaaaacttaatgtgtatgcctgtaagtagatgtttatttatccttttaaatgtccaaaagagggccgggcgcggtggctcacacctgtaatcccaacactttgggaggccgaggcaggcggatcacaaggtcaggagatcaagaccatcctggctaacacggtgaaaccccaactctactaaaaatacaaaaaattagctgggcgtggtggcgggcgcctgtagtcccacctacttaggaggctgaggcaggagaatggtgtgaacccaggaggcggagcttgcagtgaggtgagccgagatcacaccactgcactccagcctgggcgacagagtgagactctgtctcaaaaaaaaaaaaaaaaaaattaaaaattaaaaaaaataaataataaaaaaatgtccaaaagagaaaaaatcaaggtggaacaaaatttttgtttatggtgtttctcttcagatggtgtgcttttttctactagtttatatctagatatacacatatatgtatctgtactcacattgttcatgtccataaacacataacagataaaatatataaatctgcccaggcgtggtggctcacacctgtaatcctcacactttgagaggccaaggcaggaggatcacttgagcccaacctagacaacctggtgaaaccctgtctctacaaaaaaaaaaattagctgggcttagtggcacacacatgtagtcccagctacttgggagggtgaggtgagaggatcacctgagcctgggaggttgaggctgcagtgagttgtgatcatgtcactgcactctagcctgggcaataggtgtgagaccctgcctcaaaaaataataaaaataaaaaagtctaatttcaaagattttgtgcatctatggtcattttagaaaccatgagaagcaggagggaataatttaactttttttttttgagacagttgccctgttgcccaggctggagtgcagtggcgtgatcttggctaactgtaacctctgcttcctgggttcaagtgattctcgtgctcagattcttgagtagctaggattacaggcatgtgccactacgcctggctaatttttgtattttctgtagagatggggtttcgccatgttggccaggctgatccggaactcctggcctcaagtgatcctccctccttggcctcccaaagtgctgggattataggtgtgagccagcgtgcccagctggaataatgtacttttaatgtctcccaaccataatcacttttgtcatgctataaactcatactcagggagtagtgctgtggaatcctaccattcattcataatagaaataggaatttttagatccataaactgctatgcccctgatcagtgggtcttacaatgcaaacttatccgcagaaagattcaaatgttactacgaagtagttagaaagaaagagggaagcctgggagaaagcgttgtaaatccttctcattcaagccagagaaatttccaggatactgggcgaagggcagcaactcagttttctcagcaaactatcctcatctaacagggctccaggaaaatatcagccatgaccctgccaagtccagctttgctcctcttgacccaggacagtgatgcacctctagtgactgaacaggaaatgtgacaagtatagctgaagggataactgatgcataactaagcaagcacctctgctgagctggtcttcagagattaggggctgagcttctggtcctggggtggagaaccttgcctcataactgaggcatacacagcgagcctgttctaggcatgcctgccctgcccttgccactttctaggggggccacccctcccaggaccccgctgagaggacagcagccatgttgtaaagcatatgatacctcatctcttcctctgttcagaaaactgaatcatgagtggtcattgacttgagcgaaacagaaattgtgggctggccagtgacctaggacaagtagcctggcatagaagggtgggctaggtcagggccttttcctctaggaattcccctctccttcactagagaagagagagagctgttttgctttctgtttctttctctttcttttgcctattaaacttctgctcctaaactcaaaaaaagaaaaagaaagaaaggtaggctgggccaatcacatgctgtctttggaagctgaggccctgaggaggtcagcccatgggaactggagctgggaaaagattcattaagacatgacaggagtttacactatacccagtggccagggcaagccgccttcctggagaagcagagactgagtggggagaggacactgtcagaggacacagagccagtgcaggtggagggacagacaccagagacaggacctgtgctcaaggccaggtggaggcaaaatggagtgacccaacagtgagaatcatttttgcactgaagcaaatccaggaaaagtcaatgacgtttcttaaaaatttttaaataaaaacataaaaaaagtttaaatagttatgttgcgtccgataaagaaatatgtttagtcttaaaacttgaactactttgttgaacagtaatgtttcagagaagattgttactaccatttgattgctggaatattaacatacagacacatacacagtacccacacaggcctagctttccagccattctgtgtttttaccaagaaccgtgtcacaaaactcatgacctcagaatgtacaacacttggggggcaatcctagagccaccttgggcttgcgaacaccgtctgtttcactcgaactatctcaagtgtggtcccatctttcctgcagccatgactagacaaagacctactatccttaataaagcatttaaacatccctaagcagcttcttaggctatgaaatctcttactggatatttaaactataatagctataggtaccaaaagccttatgattatacattgagctagcaattctacatgttcatcctgacagaatcatcacagtgtttttgtcttttgttttgttttgtttttgagatggagtctcgctctgtagcccaggctggagtgcagtggcgcgatccacagcgtttttttaatggcaaggatggaaacaacctaaatgtccaacagatggggcctgaataaataaattacagaagagccatgcagtggaatactatgcaagcatctaaaggaatgttctaggccgggcacagtggctcacacctgtaatcccagcactttgggaggctgaggcagacagatcacttgaggtcaggagttcaagaccagcctggccaacatgacgaaaccccatctctactaaaaatacaaaaattagccaggtgtggtggcacatgtctgtaatgccagctactcaagaggctgaggctgaagaattgcttgaacccagaaggtggaggttgcagtaactggagattgcgccactgcactacagcctgggcaacagagcgagactccatctcaataataataataaataaagttctagaaacatatgtgctgacacaagaggatcttcacattagagtgttacattaaaggagcaagatataaagggttatgaaaattttaagatagacgtcccaaatatgtgattcattgggaagataaagcaggttacgaaacggtataattatataattataccatcctgtttttttttttttaaatgtacatgtacctgaatctgcatggctacattctaaatggatgtactttaaaatgttatcagtgtaagctgtgggttgtgggattctaggtgattttattttcttatctctatgatttttaagcccatcatataattgttttgaatagataaacacttacttatatggttgaaaaattaagacagtattaatgtttaccatgacaagtctcaccctaccccaaccctgactcactccctctttctataaataatgacttttagtgtcttgtcatcccagtgtttattttactaatttatttatttatttaatttttgaaatggagtctccctatgctgcccaggctggtctggaacccctggcctcaagtaatcctcccacttcagcctcttaaggtgctgggactacaggtgcacactaccacacccagcctcttcccaatgtttctttatcaaatacaagcaaatgtaaatatatattcttatttctccgttttcttatgcaaagttatcccatgtacaccactgtgcaccttgcttttttcaccatttggtaatttttttaaacaaaggcttaacaatcctggtaatggatttctgtgctcacagctttctctcctctgctcacagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacaggtgagtcctggagagtatttcaggatgtgtgtttgcgtgtgcatgtgtgagtgtgtgtatgtgtgtgtgtgtgatatgtgtgcatgtgagtgtgtgtgtgtgtgcgtgtgtgtgtgttacaaagatcccaccacctctactgccttatatcccataaggaaacttttgggttccttccattattcattctttattcattgactctttcagcaaatatttagtatatgccttactttttattaccagggttatactaggctcagaggggcccccccaaaataaggtacagtccctggcttcaaataattttctgaacagcagatgtcctttagtcaaattgttctctgttttcttctttcccctatccttttaatctggttatttttatagttttctttcattgatcttttttctactgaacggatataatctcctcagacacagaacagccttgaacaattggggtctctgaggccaagggaaagaaagtaagaaaatgttgaggagggtggtggctggaataactcaaaaccctgttgcctgctatgacccagtggggcctcgctgtcccgagatggagggagcctcagaggtgccctctacagggcacaggcccacgccagcagtgttttagaggagcatccaggctgtcctgggagaccagaggcctgagctcatgtcttcctaggaaatcctggaatatttgatctgtcagggaccttcacagttatcagctctacaaacgttgcattttagagatgaggaaatgaaactctagaaagaaaaagtgacttagagatcagacgtctttgggccacagtgtcaaatctgctgaggagctgggactctgagccaaggctcctgtcttccagttctatccaagctgctgccagggtcctgccttcttaaatattcttaagcattcatcttaaaagtaccatcaatatgtaattttaaatgcattctagaaacagagtaaatatccctgaaaggttatattgtgaaaaaactgaaatgtgtgatattctctatcaaataattttcatccttgccttggcctttggtaattaagtttttcccttccacataacctaaataagcttggttttgtctgaaataagtatattttccttcataaatacaaaatgtcaatatatgttaccatcaattacactgtaaggctacaacttggggacaggtatggtggctcagaactgtaatcccagcattttgggaggccaaagcaggaggatcacttgagcccaggagttggagaccagcctgggcaacagagtgagactctgtctctacaatttttttttttttttttttttttttgtgtgacagagtctcactctgttgcccaggctgaagtgtagtggcatgatgtcagctcactgcaacctccacctcccggattcaagagattctcctgcctcagcctcctgagtagctgggactacagctaatttttctatttttagtagagatgggtttcactatgttggccaggctagtctcgaactcctgaccttaggtgatccacccacctcagcctcccaaagtgctggggttacaggcatgagccactgcgcccagccaaaaaaaattaaaaattagctgggcatggtggcaagtgcctatagtcccacctacttgggaggctgaggtggaagaatcacttgagccctggaggtcaaggctgcagtgaactcatcactactgcactccagcctgggcgacagagcgagaccctgtgtcagcaaaacaaaagactataagttggtgttggaccacattcctcttagcctctgctgttgctgcagcatcacagtctcctaggagaattgcactctttccccaccccccagggaaacaaaataaaagccatttgaaaaaaacatggattgggtggcttttttttcttttctttcgtgtgtgtgtgtgtgtgtgtgtgtgtacaggtgcttattgccaactaatcactgatgcatagcagctgtgtagcatagcagctgtggagggaactggaggggaacatgcactgactcagtgcttttatctttggggccaagcccacgtgaggaggaaaatggcagtttgagcacatgacaaccaccgagggaagtgttttcacagagaggcggtagcagccacacgttcactggtcaggtctgcagcttctgacagactgtgtgggtttgtttttgtctcctgtccagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtaagtatattgtattatttgtgaaagtaaatttcatggtttcaatatgaaaagcttaatcagcaaaaaacactttggctggaggggtggggatagagaggggtgggttgacagaatattacagctagacagaaggaataagctctggtgttctacagcactgtagaatgactgtaattagcaacaatgtattgtatattttcaaatagctattattagaagagtagattttgaacgttcccagtataaagaaatgatcaatgtttgaggcgatagatgtgctaactatcctgattagagtatagagtatgagagatctacatctatacatggaatcgaatggaattttcaatgatgttttcatacaaaaaccacaaaggttaaaataagtaaaaaattaataatagctaaaaaaaatgatgttaaaaggcaaaaaaaaaaaatgaaaacaaaaaagtcattttggtaaagtgcccagcaagcctattttgtaaacaatggagaaacctgagaaaagtgaattctgcctaccagttatatgaatcgggttgttgtctggtcatgagctgctatagccctgccattgcaccaagtccccatgcggtctgtcactgtagctctttactgtcctccctaaattttgttatagtgatgataattctatccctcactgcctcagcaattaggatcttgagacaaagttcattcatcttttggaacacctatggaatggaagactggcttggttttgagatggtttgcgtttcggctgtaatgctgatgttgtcctgttctttcttctcttgatgacaaaatccctgtctaaaacagtccttcatgaaagtatcccagccgggggtgcagaatcacagatgccgcgttcaggatttagagatattgaggggaaactgcttttaggaaagatttgtttgtttaaaaaaatgttataatccatactactagctatatgagacttctctccttattctactgttttaaaaaaatccattttggagtcacaagaaagtttcttgtaatatcaaacatccagttttttgtgttttttttttttttttttgagacggcgtctcgctctgttgcccaggctagagtatagtggtgagtcttgactcactgcaacctccgccccactgagttcaattgattctcctgcctcagcctcccgagtagctggggttacaggcacccaccaccacgcctggctactttttgtatttttagtagtgctggggtttcacatgttggccagactgctctcgaactcctgacctcaggtgatccacctgcctcggcctcccaaagtgctgggattacaggcgtgagccaccatgcctacccagaaatggttttaacggaatattttaaatcaggaagacagtagaagctgaagattgtgtgtgggaaagaagggaggagaggtggtcagagggagacacacagtggaggcacagccagcccctggatgcaactgaagaaccagaagcaagtgacagccaagtcagtactcatcatgggaagcacagccccaccgctgttcctcaacctcctcagagcctgagaaccaagccctgactccatggctgcctccaccccgtgggcagtcaactcagctgaacccacatccattgccttgggaaacccagggaagcctcgaggtttgacagagctctgataaatttctagttactgtcttgggattactctagataaagaaaatacattaaaatttacattggaaccacctgcattttagaggtgactttggaccttggggacaaggcaggggtattcacttgtctagtgaaggcaatttgggtctaggccagctgtggttcaagtcctagagtggtggtccttaactcacaccgtgcctttatcgactacagttgcctgggacccatccaagaagactaggtgttaatttatgtgtagtcagcctaggcattggcattttctaagtgccccagtatgatgctagtttgcagccagtctgggaaaccactctgtcttgaagatttttttccccaaagggaagacgcagacattgtcctccagatggtgctgtacgccaggacttcaaacaagcagacagcgagatttcttttttgctggagagaaatttggtggaaaccaccttgtttaaaaacacttcattgtgttggctttagtgtacatactgtcatagagtgggttctaggaaaaaaacactgcatctcacattaatatgacaagaaaagggcagagcagattatatttggggaggaagggggtatttttgttaagtagaattatttttataatataaaattcatagaaagtaagccatcctagccgatggggattagttgcaggtgatgcactatgagagcattgcaggaggggcatggatttcaaaagagtcagtctcaaagacagaatgcactcacacctatatttaccttcctgaaaccctatagaaaattcagctgagggccgggcacagtggctcacgcctataatcccagcatttgggaagctgaggcgggtgggtcacttgaggtcaggagtttgagaccagcctgaccaacacagtgaaaccctatctctaaaaaaaaaaaaaaagaaaagaaaaattagccaggtgtggtggcaagcacctgtagtcccagctactcaggaggcgggggcaagagaatctcttgaacccacgaggcggaggttgcagtgagcagagatcgcaccagtgcaccccagcccagcctgagcaacaaaacagaagtcaaaacagaagtcaaaatagatgggtctacccaggggaaccctgcagaggaaattggtgccattttaaacgacagagcctttctagaattggtggctacagaaagtaggaataggaggaggggaggagatgaagctggttgattctacttctgcacaattttctgggtcattcccaccatcccttctcaccacgaccaccaccaagacacatgagacagcagaggcatttgttctgggcaggacagcttttctgaagaaatatagtaggtatctaggcagactacagcttcaagagcgaggctaggtacctcagggtagggctctctcgactttgccttttggggaagggagctgcccttatgtgaagcctgcaagttagaataaacccaagcttaaaacagcaaagaccactcatgccacacatccccaaattgatcaacccagtccttgtgtgtgtgtgtgtcccccaaacacactgctggagctgagaaggagctgaccaggttagtttcgacaactcagtccttcattcagaaagatgaacaaccaaggatcatgatgggaaaaccaccagcacataagaggaaaggtcaggaagaacaaacagaatagtccctgaaggaagcagataaattagggaactggaaggaaattttctaaaaatctcatagtgtcctgcaagagttttgggaagatagtacatctgtaaactgttaataagaagtatgttctaggcttaaagtataataataataaaaaaagaagtatgttctaggaaatgaagcaatgaaaacaaagagtctgtagaaattagacatatgactgtcacaagattcggtacctgaagtagatgataaaatttcggagatcttatggagtttaaagcaaactatagagaggcaaaaaatataatagaaatgcaaaaaaaaatcagaactaatctgaactcctgttaatacccgtccagtagtaggagttctggagtgaaataattgggaaaatggaggaagtgacattaccaagtaaataatagatggaaacttctcagagttaggggaaaataattattctgcagattgaaagatttcactgcttaccaagtaggatgaatgaaaagggaatatatatatatcttctctatatatatatattctatatatatatatcttctatatatatattctatatatatatctactatatatatattctatatatatctactatatattctatatatatatctaatatatatatatgtgtgtgtgtatatatatatatatatatatatatatatatatagtattgctaaaattttagaatatcagagcatagaagatcctaggagatttcagagaggaaaaagctatcaagaagaaaaagggtgagaaccatttttggctcaaacttcctcagcaacaccggaagtggagaagtgcactcaaagttctgaaagttattttgtatcagaattctgtactcaagcaaattatcaatcaggtggagtacaaaacaccagaaacttggtgtatgaaaattcagaaactagaccacatccagtgcatcttttttaaaacaactacttggccaggcctcgtggctcactcctgtaatcccagcactttgggaggccaaggcgggtgaatcacgaggtcaggagttcgagaccagcctggccaagatgatgaaaccctgtctcttctaaaaatacaaaaattagccgggcgcggtggtgggtgcctataatcctagctactcgggaggctgaggcaggagaatcgcttgaacctgggaggcagaggttgcagtgagccaaggtcatgccactgcactccagcctgggtgacagagcgagattccatctcaaaaacaaataaataaataacaactacttgagattatgtgtgtcagaaagcaacaaaaactcagttcaggaaataggacaacatgggatccaagaagctagaaataaccgcagaatgcaatgaaagcaaatccaagcaaacggctgagccgcaggcctagaaagaagcgaatatatattagaccattcaacaaataggaagatcaaacagctagaagatatcaaagaccaaggaggaaggtggcactcttgcttctgaatctctgcaaatgtggttccttctacaaaaggaaaccagcatgctttattgttaacctactttttttgaaaaagaaaaaaaaatggaactagttatagttttctgcagtttaaacattctaaaagattgtatcatgtggaaagctttttttcttcctcattacacaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagtaagatcctccagccagcggggagatgggaggaagaatagaagagaacataggaaaccctgaaagagattcctgggctgctttgaggtctggccaggaggcagacagttgtgttgagtccattgaagagcagagtgcaatttatgggtttttaaaaaaatcataacttatttggaccataaaatttatcaaattctattttttttttctttttgagatggagtttcactgtgttgcccaggctgcagtgcaatggtgcgatcttggctcactgcaacctctgcctccttggttaaagcaattctcctgcctcagcctccagagtagctaggactacaggcacccaccaccataccaggctaattttttgtatttttagtagagatggggtttcaccatgttggccaggctggtctcgaactcctgacctcaggtagtcctgcgttggccttccaaagtgctgggattatgggagtgaaccaccatgcctggcctcaaattctttaatttactttttcttactttctgctgaactcttttttttttttttcttgagatggaggatggagtcttgctctgtcacccaggctggagtgcagtggcatgatctcagcgattctcgtgcttcagccttccgagtagctgggactacaggcacgcgcaccatgcctggctaattttttgtaatctagtagagatgtggtttcaccatgttggccaggctgttcttgaactcctgacctcaagtgatccgcctgcctctgcctcccaaagtgctgagatcacaggcatgaaccaccgtgctcagacctgaactcattttccttcttaatgtattatacctcaaaggattctttcattggcctccataggacatgaactttctgtgtcgttttgtggtcttttatctcccattcacaagtagataataatttacctggataaaattttaggttcaaccctttggagatattactcctttatccactttttttttcttttttttgttttttgttttgatatggagtctaactccgtcatccaggctggagtgcagtggtatgatctcggctcactgcaacctccacctcctgggttcaagcgattctcttgcctcagcctcccgagtagctgggactacaggcatgtgccaccacacctggctaatttttatacttttaatagagacagggtttcaccatgttggccaggctggcctcaaactccttacctcaagtgatccaacagcctcagcctcccaaagtgctgggattacaggtgtgagtcaccacgcccggcctctttatctacttttatccagggttattgccaagaaatctgattcttgcttctttgaaagaaatctattttttctctttggaaacatttagaatttctcttgatctttgatgttcttaaattttactatctggtatggcacacagtgaggtttttcagttgaggtcctaatatctttaatacggtttttttgttttggtttgggtttttttttttttttttttttgatggagtctcgctctgtcacccaagctggagtgcagtgttgcgatctcagctcagtttaacctctgcctcttgggttcaagcgattctcctgactcagcctcctgagtagctgggattacaggcgcccgccaccaggccctgctaatttttgtagttttagtagagacagggtttcgccatgttggccaggatggtctcgaactcctgacctcaagtgatccacccgcctcagcatcccaaagggctgggattacaggcgtgagccaccatgcccagctcattaatatctaacaggtttgtttagtcctggaaaattttttgtcattatttttccagatattcttcttcctttcatttatgcttttctagccttccaagtagtctattattgtgatacttctacttctgtgccctagttctcttgtctcttcattccatctcttcattcctgattcattcctgatgccttctgcgagtccctcccctcatctgccagcatattaatgcattcttcagatatactcattctggcttccatcccacccaccaagatctttatctcaacaattgtttttcccatccctgatatctccagtgggttcttccccataactgattcttcctgcttcattattctcccctactttgctgtggctatttttcctttttaaaaaaaacatttttattctcttccaccatttctgtctcccgtggtataggttgtgctgctttatctttcttagtctcagagctcctcagacatcttgtaattttccctgtgagctcatctttaaccccttgcaccgtcggcagccttggcttgtaatatctcccatgggttgtggtaaaaagcttaggccttggtttgtgctcctcatacatttggagggcaaagggttgagcctcactgaggatggctctagtgttaaaatccagtctcagtgccactcctccaccccaagtatcctttccgctggggtattttgcagttccctctattggaataggttggggagaagaggctgctggtgttgccattgcctacacttgtttcccatggctggtgtacctgctgggcacgagcactggctcactgccccaagccagccctgctgcttttctacctgtagcaatgtcgcattgatccagggacccaggtttgtaggcaggatcacctggaactcacaggcgtggtaggagacgtgcagccctgcccttgccctgcccactcctgcatgggtggtctcgagctcgctctcacgtgaggccatcattctcccccaggatccaaccaatttattggcctccagaaatgtcttgcatttttggtgctagtttccgattgaggttttgttgctgttgttgttggttttgactatgattctctttctctgtcctctggcatgtccagcattgggttcacagagacagctggcagctggtgctatctgtaccgtcttatccaggaccagaaatctttcttattatgtacttcactggccttgttacatcttgcttatgaagtttatttttattccactgttggggaaatggacccttgaagaactttcatcttctttgttttaataaaaactttttacataaaatgtgaactggacattttcacaggaaaccaacggaaggcattggttgagaatgcaggctttgcagttgactatgatgtagctctagactttgctacttcataactgtgtacccttggacaaattgacttttcggagctggctctacccagtccccctttgcaagccctgcagagagacagctggttccaactgctggtagatctctgaatttagaaattggggtgcttagaactttttgccccagttacaattctggaacaacagaaaaatatcactgacatcttattcctgaaataaaattttaaagctagaagagatggcctgggctttggtgcattccttcatttcagagaggaggagactccaagcatcgtgccattgttaagcagtggtggaggacacattagaacctggccccaaccccttctgaacgttttctttctgctacatcaggcttgcttctaaagtagttgttatgattgttatatattcccagtgggtaccaagaatagtaatcctttttttttaaagggattttgtttgatattctggatatgccacagttccctacatgttggtctgcttttttcttgttctcttaggagagatgaagccagtattgatttgagcatgctagccttaatcgctgagttatatcggggaatggtgctgctttcttctgcaatctgctcttggatctctttgcaaaactctgatttactccttgtgattatttgggaaacaaatcagaagaaaacaaaactggtttcctttcctctcccccttacattttttatgacctatcttaactttggcaggttcgatacagaggaggaggctatagcaatcgctaacgcagctgatgttgggttagcaggtaggtgtttgtccttgttcaataccagtcataatcatttttctccagctcatgccagatttacccttttaaacatcaccctgggttttgagacagaaacttcaatgaggtatgtgttttgttgctttccaagtggtggaatggatttggatttgtgcaagtatgtgtacttttcccttgtccccatgatacacatttgggagctctctaattacagctgtgggaagaagagaaggtgcacattattctacttttctaggtggagaactgcacacatctcaaagtcccacattctcagaggcttaatccccagaaattccaaatgctttttcttcccttttgcgtggctcctgtaagcctgaacagaagaggaagggcatcagcaaggagtgtcagggacaatgaaaggagtgaagatggtgtgtgcagaggtgcctctctgatggctgacattcctttagtttggagatgggccaggtggtcactgcatgtactctataaccctgagaaaattatgtaatagcatccacagcaaatgaagtactgcagaagatacaaagacatacaagatgccactatagctctatagaagcttcccctctagctgtaagagaactatttataccaagaggaatgataagcatgctatgaggtcccttagagttatcgtaaagctggagtaagatgtgtgcacaaggacgtttataacactgagttcagcatttgtctcttccttctcgatggggtgatggtggaggaagacgtaccctgaactaggtcataaatgatgggcagaattctggttgtgcagaagctggaggagagagattctgggcagagggcaccaagggagttgagaagcaaagtaagaaagggtgaggagaatttggctgacaggtttggagaggatggttggtgattggagtaatggaagatgaagccagaaatgttgattgaaactacttgtgggggagagggtgttgaatacccactaatgaatttaaccttattttataatcaggagtcatcgaaaggcttgggcaaaaatgtcgtgtggaaatctaacaggtgtgcaggtggattgaatagtagaaaacaggaagagggtctcgataggagatagtgagagtagaattgaagcaagaggtgactttcaaaggttttgagatgaaaaagtggacaagaccaacctgggactttatctgggagcagggaagactccaggcccaagtggctggacaaaaagtcatcaatggtgccctcatctttaggcatgatgtctttaatgactcttctaaatgccatatatgtccttttatcctgtgacaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtattaaggtgtctggttgtgcttttttccccctacttggtgatcttttgagtttttattggatgatattagaccagtttgcatttgtgtaaatagcactccctcccccagagagccgtaatcagtgagtgccttggggaaggagccagcatgtgaaatgatgtgccctaaaacccagagaagggcctgtccatggtgtgcgcttatagaatgtttgctaagctgaactgagaatttacctggtttgcagaggtggcggtcacagaaaggtgtataggccagccgtcacagattggcctatctctctctcctacacgccccactgttatgacttcctgggctcaaacaagcctctcacctctgcctcctgagtagctgggaccacaggcacctgctaccacactcagttaatttttctttcattttttgaacagtcagggtctcactgtgttgcccagactggtctcaaactcctgggttcaagccaccctcccgcctcagcctcccaaagtgctgggattatgggagtgcaccattgtagccagccctcaccataatttagaacacagacagcactgctgcccagtggttagtggacatttttgcaaatgtcgtctcacattttacaatcacgtattgctcgacaacagagatatattctgagaaatgcgtcattaggcagtttcgtccttgtacgaacactgtagagtacttacacaaacctggatggtacagcctcctacacagctaggctatacggtctagcctattgctcctagggctacaaacctgcacagcatgctactgtactaaatactgtaggcagttgtaagacaatggcaagtatttatgtatataaacatagaaaaggtacagtaaaaatcaagtataaaagatttaaaaattacacttgtaaaaggcacttaccgtgaatggagcttgcagaactggaagttgctctgggtgagtcagtgagtgacagtgaatgtgaaggcctaaggtatgactgcacactactctagactttacaaacactctacacttaggctacactacatttattaaataatatttttctttcttcaataataaattacccttagcttactgtaactttttactttataaatttttaaaattttttaactttttgactcttttgtgatcacacttagcacttaaagcacaaactaattgcacaactgtataaaaatatattctttttttatatccttgttccacaagcttttttatattttaaatttttttaaacttttttgttaaaaactaagacacaattacacacattagcctaggcctacaaagggtcagattcatggatatttctatctcccacctcctcatcttgccccgctggaaggtcttcaggggcaataacacgcagggacagctgggcccagtggctcacgcctgtaatcctagcacttcaggagtccagggcaggcggatcgcttgagcccaggaatttaagaccagcctgggcaacacggcgaaaccctgtctctacaaaaaatacaaaaattagccaggtgtggtggcacgtgcctgtcgtcccagctactcaggaggctgaggcaggaggatcgcttgaacccgggaagtcaaggctgcagtgagccgtgaccgcaccactgtactccagcctgggtgacaaggtgagaccctgactcaaaaaagaaaaaaacgtggagctaggataacaagacctacctgaggttcttaggagatgtcatgcatcagaaatatgtccatggtggtttgcttgctttcctttttcatcatagatttgcttgtaagcagacagtgcataaagaacattcctctctgttaatgaaacccttttggtgttgaggggcccatgttttcagaatttttaaggcgcttactgaggtctgcaaaaacttctcagctcttcactgtgaattttcatggggattctttttcttctgcagttttttcttccttgcctcttcttgaggtatgtgttcctgttccagttccaacaactcctcattagtcagttcctcaggaaccacctgtaggagctcctcaatgtcttcttcttccacccccaggttaaaattgtttgccatctcaaccacagccttgttggtttttgcaacctccttgtccttggcaaatcctttgaaatcacggatgaacctcttgagtgtcttcttccagatgtcatttatacgttccttggtaacatcaccccaagcccaagcaagggtcctgatggagtcgtagatgtaatcctttcagaattgcatcagcgtcttctccgtgtcttcctttgttgcagtaataacctgagcaaagctgctcctcctcaggcagtgggccttaaaagctgctgtaactcctttacccattggttggtaatccttaatctcttgtttcaagatcagtcacttgatgtggcctcttactggcaacaatagccgtggattttctatgacaaagggaccgtgatgaacaaagcaacacgagattaattgaagcacaagagaaaataatgcaatcaagaggcacagtaaacaagacacgtttatactgctggtataacccagtatttcttttgttttgttttgttttgtttttgagacagggtctcactctgtaatttaggctggagtgcaccggcaccatcacagctcactgcagccttgacctcctgggctcaagagatcctcctaccccagcctcctgagtagctgagactacaggcattcgccaccacacccagctaacttttaaacatgttttttatagagatggagtctcaccatgttgtccaggctggtctcaaactcctgggctcaagcaatcctccagcctcagcctcccaaagtgctggggttacaggagtgggctactgcacccagccacatactgttttacaataaactgtttttaataagtagaaggagtacactgtaaaataacaatgaaaagtacagtataataaatacgtaaaccagtagcatagtcacttattatatactgtacataattgtatgtgctatactcttatacaactgagaatgcaggtttgtttacaccagcatcaccacaaacatgattaatgcattgggctgcattggactttatgatggctacgacatcactaggtgacaggaacttttcagctccattatctcatgggtccataaatcatatatgcagtccatcactgacagaaatttcactatgccaggcatgaccgtataagcctatgtgctctcttcctgctgcaataaagtctcagtcctgcaactctgggttcatcatctttaggagaatggaggtgataatactctccatgtaggcttcaaataaaggaagctttgctgcttgctaatctcaactcaacaagagaggctctagggaccaattagttggagaaatggtgactttgtttctttttttttttttcctttcttaactttgttcctgattttaatggaaatgcttattttactgttgatatgtggatctggcctttccttctcaacatctttaaacttttaattttgaaataattataaattcataggaagttgcaaagataatgcagagtcccgtgtacccttcacccagtggttcgcttattacctatgtaatacaattatcaaaaccaggaaactgataccagtgcaaaactgttaatccaggccttattccaatttcactcgtttttatgtgcactcatttgtatgtgagtgtttgtacacctctacctaatttgatcacatcaatagttagatttgtgtaggcagcacctgaatcaagatacagaactgtttcatctctacctaggaaatccctggcagtacctcttcataaatgactttgaaagtaacttggcaagattggtagcttttttaaactttcctttcactattatatacatgcaaaaaaaaaggatacataattgaataagtgaatcgctcaatgaattctcagaagaccgagatcaaggtgtcggcaggtttggtttctcctgacgcctctcatcttggcttgtagatggccgccttcttgccatgtcctcccatgatctttcctctgtgcctgcgtgccccagatgtctctctgcaggtcctaatctcttcttctaataagaaaaccagtcgattggattaggacccatcttaatggcctcattttactcattttaacttaattaatcacatctctttaaaggctctatctccaaatacatttcaggtactgggggttagagcttcaacctatgaattttgacataacacgattaatttagtcagctgggcgcagtggctcacgccagtaatcccagcactttggtaggccgaggctggtggatcatttgaggtcagcagtttgagaccggcctggccaacatggcgaaactccatttctactaaaaatacaaaaattagcccgtcatggtggtgggcgcctgtaatcctagctacctgggaggctgaggcaggagaatcgcttgaactggggaggaagaggttgcagtgagccaagatcatgccactgcactccagcctgggtgacagagtgagactccatctcaaaaataataatttagcccacaacactgaaggaatatttttttaaatgcctttattttctggctggtcatggtggcccatgcctgtagtcccagtactttgggaggctgaggcgggcgggtcatttgaggccaggagttcgagactagccttgccaacatggcgaaactccgtcgctactaaaaatataaaaagtagctgagtgtggtaacacacatctgtaatcccagctactcaggaggctgaggcacaagaatcacttgaactgccaggaggcagaggttgtagtaagcgagattgcaccactgcgctccagcctgagcaacagagcaagactgtctgaaaaaaaataaaataaaaattcctttagtttcagtaatggaaagtcatccttgttgaaattataaagattttgttcctttacttagcctagtatttgctctctcagtaaatacacaactcttacaggattgaagatgatccaggagccacgtaattagtttaactacaataccccattcccattctcatacttcaacaagcatttatctcaacaaaattatgtgaacaaatatgaacttgaaagagccaatcctttaagataaatccccattggttaactaggcctaaatttaaaatagacctaagtgggacctggcactgtagctcacatcagtaatcccagcactttgggaggcagagggaggtggatcacttgagccaggaatttttgagaccagcctggagagcatagtgagactcccccatctctacaaaaaattagtccacacctgtagtcccacctactcaggaagctgagaggtgggaggatcacttgagcctgggaggtccacactgcagtgagccgtgatggtgccactgcactccagcctgagtgacagagcaagaccctgtctcaaacaaacaaaaaacacctaagtgagcatttgttaactagatgtcacacacatgtactgagttccccccaaaacccacacctttgttcagtttgggaactccagagttcacctgaaccagtcaatcagagctcacctgccttaaccaatcaggactcagatgtatcaaccaaccaggcgtcatctgtatcaaccaacccaaactgagctacactgaccaatcagaactatgcaagtttcaatccttcatttacatatggacctgattggaaacctgggtagaattttgctataaatccagaacgcttgctttgttttttgaaacccatctttgttttacacagaagaccataactctgtggtttggaaactgttcacggcaataaagtctctttccttcaaattccttttcagagaacttctgttcacagttgctaatggagtgagttaaaacagcctggaaaggaaggaactactacctgtttgaggggaaagctccatacagtactaccatatatgaaactccagaaaattcaagctaatctctagtgattgccaggggagagggggattacaaagagccacgaggaaacttttatgggtaattatgtttgttcaacagcttgattgtggtcatggtttcacagatgtgcacacatatcaaagcatcaaattgtattatgtgcagtttactgtaagtgaattatacctcaatctgcatttttttttctttttttctgagatggcctccttctgtggcctaggctggagtggcccagtctctgctcactgcaacctccacccccagggcagaagcaatcctcccacctcagcctcctgagtagctgggactacaggcatgcatcacaatgaccagctaaatttttgtgtgtgtgttttttgagacaggatttggccatgttgcctaggctggtctcgaactcctggactcaagtgatccacctgccttggccttccaaagtgctgggattacaggcatgagctaccatgcccggccctcattttaaaaatggctttattactgataagagctagattagaggatgcagtgtaagtatactctctccagaatctaatcaccctaccatgctgtgggccttctggcacgagggacagactgcctgttaattgcagagaaccacccacacagaggaaggcgagctgactgagcatgctcagttcttccggaacacttgtcttcccacagggaaggagcaggggatgttagtccagccttctgcaaatttttttctttctgtaaaaggccagatagtaaatagtttaggctttgcagacagtccctgtcaaaactcctcaactttgttgtaacataagaacagccatagataatacataaatcagtgaatgtggatatgttccaataaaactttatttatgaacacaaatctgaatgtcatatagttcacatgtttcaaatttttttatttatttttaaccatttgaaaacataagacccacttttcggctcatggggcgtgcacacacaggctgtaggccacagtttgctgacctatactcaagggaaatccctctaccctgaagcataaagaaaacaaatttccccctaaaaataagcattacagaaaatacagacacctttatttagattagtgcatatatttaatagtgtgatattagaaataccttgtcaacacatagggaaaaataatatattttaagcaataaaaccaagattaaaatagtccatgatagctttgtcacacaaaaaacaatggtagtcactctcctccccgcgcacaaaaggtggcatcactggcttgttgagtggtacattttcttaccttgctgcatgtttttcagatagttccttagtcatacacatgcttagccttgtaatgccatgggtatgaatcctccttcattgaatgtaaaccagcaactaaagtgcttgttagcctgtgagccctacaaacacccactcccatattctagggcctgtttttctctgtccagagctcttagcgtgctttatctcccaaagatcctcaatgataagcagtccaccatgaagaatgctggttggtcattccatctcgtgctttgttctgatgagaaatggggtgacaagacaggactcactttctgatcactactgtgatgtttgatttcccagagattcaagatccttctgtgatggaaggatcagagaggccaggctgagatggccaaggacagaaaaggaggaggggcagaagaagtccactgtaaacctagagggaggggtggcccgggtgtgatccacaggagactatgcaggccatctctccctctgaccttggctctctggatccattaaaagaaattcctcttagtcctgggaatagaactttcaggtggcccaaaagttccaccagaatttgccctccatccatcaaggcaggagttctttgtttagtggaaagcagaactctacagtttaaaaaatttgcattcagttcttggagccactacttcttggccatgacctctgggaagttatttaacctctctgggccttcagagggctatctgcaacataagaatgatagtatctcctcttcaaggttgattataaggatcaaatgagtatgtaaactgcatatgttatgtacataaagcggtaaatgttcactcccttcttcctcattacgcccgatgactttacatttgggctgctgtcccctatgccagaaattcacatttgcatgcaaacaaccataaccctggtcacctgataaggcagattctaggcttatgaagctcaatactggttaaaaaaaaaaatcacattttccttctaacactatagacagtattgaattggctagttatacagaaagtgtaggcataagcaaagcaattattttaaaaataaaatgacacactttttagttctgcctttccccagtaaattacaataagtaaaaataagatggtcccatgaggatgaatactgcgggagatgacaaaagcacctaaaagctgaattttttttaagaacccatggggaaacattttctctggcactcctgccctggtgtttaaataccttgcttcttcatcagcaatgcattcctagttttcccatgtgttaaaaaagcattgtgcaacaggatattgtttaggtgtgctcacacttggtaccacaacactggttctatctctcattctaatcttcccacaaaaaatgccaagggcaccaccaaggccaccagcctcaggaccaagggtggatggggaactaccctgaaccagtcaacgtagcaggctacaattaactccagttaattgctcgggagtactgctttgtgggtgggaatgttttaattgtctttcatgtttgaaataagatttattcggtagaaaaacttaaatgtatttttaaacatatgaagtgaatacatctatgtcaagttattttggaaagtacctgtcggggaccagagtatcataaccacgccatccaagttaagactgactgtatttcagagttttggaatatatacacaattgctgagtcgttatccctatctatggcagtccaaacgcacagcctacagaacataataaatgcttaatgaattaatcacttctattgcatttaatgtaaactggggatccgtttacattagagaactatactgctaaacaacaccgagaggagtcagtgtagtttttcttagagaaagaaaagataatgttacaatgctaccttcaacctgcacggcattaagctcctcctcccctttctattgcctcagtccttagaatacgattcttccttagctcttgaatggccaacagctgctttcttgagagagatgaaaactgccattgacatagcacagaattaaaaaccaggagggcttggcactgtgcgagtgttgccgtcagcacagaaagcttgctacatgcaagactccgtacctccacagatggcccgtgcctcttagacaagctattttaacatacacagccatctgactgcaggtcctacaagagaaaccgtgtttagaatgctgttccttagaggcaatcacagcagctaagacagaaatcatccctttttaaaaccttgtttcattcaccttctctaaggttctacagatagaaatcgttgttcatctttaatatgagattgtgccagctacaaaaactcaaaactcttttaagtatataccttagagttttacccagcctttatttctattaacaagcatctcagttaaaagagcaaagtttttgttttgtgccttcaaaaaccggtcttttagtacgtggggatacacatctaacccactggggaagaaggtcaatgaactattctaaaagagtgggttttgtgctgtaactcccactgactggtcttggattcaaggggtccttccactttacaatgaactgcgccattatctgtcctttgagcaataactgaaggaagctccatttctgatggaaccattcatggaaacctttggattccctctctccatcttttctcggctgaagattgtgtcctggtcactgtcaaactcagactcggataccatcaggctggagttgtgctctgtgcttcggtgcttgatacctagagagaagcacagaagcatctgaggaggaacgccgtgattcacttccagctgtcagtcgttgtggttgcaggtcctgtgatgggcacggagtggtgctctccgccccttgaaagcaatcactcaaaacagcaggcggtttgggtttcctagcaagtaactgcaggggctttgatgcctcacccgagcttctgtcccagctttgacactcgccagatgcttgagcctgggcaagataccgaacctctctgagctttcagtctcctcctctattcaactggaagataacaaagcatctaccccatgagtttatgctgaggattaagtgaaatagtgcatgtaaagctctcttggcccagcctttagtacattgtaagcatccaacaaacgaaagcttctgtgattttaccatttggttaaaatatttttggtagaatatttgatttcagggggtcaacctaagatacagaacaggtataagattcaattcctactctcaaaggatttatggtgtctagctaggggtttaagacatagacttggctgggcatggtggctcacgcctataatcccagccctttgggaggctgaggtgggaggatcacttgaggccaggagttcgagggtacagtgaactatgatcgtgttgctatgctctagcccaggtgacagagcaagaccctgtctcgggaaaaaaaacaaaaacaagacataaaaggcatagactcatgagaagatggctcataacaggttagatgttttttaaattgtatatgaattaggagataagcacatatacttatggcaggggttgcttcagtaatgtttcccatagggtgatgttgcagaactttctccttagttcagctaaaaccaggctcttgtcacactaccaggaaagattaggctcacggaaacatagaggggtgagaaaaatggaatttattggtcaaaaaggaaacaaaaactctcagcaaatagagagggggtcttgccaacaacctcctgcctcacagattgaatcccaggttaccacacagaaactgaagaggccaggctcctccccactgcaaatgacacgaacttcctgtggctccatcctctttccccagtgcgcaggtggacattacttagggagaatcagctgggaaagggcagggccttcactggggaccagcagtccagtttttcagccttcaggctgttttaggcttggaggtggggtttcgccagggactcttggctgtctcctgtctctatcagtgagatttgaagaagagattttagacaagaggacggggaaggtcatggagtatgcagaagcatccgggaatatttagaaaaaaactggtttgtttggagcaaatgattcatgtaggaaataatgaaggagagaggccggagaaaggcagggacctcacagaaaagcacatgaatacaaagtaaaccatgaagtttggattttatcctaaaagcagagaaatgacactattaaaatgttgttctgagacattaataaaaccacagtgtgcaggatggaagacggacagtagacatagaggttgctgtggtctgaatgtttgcacccccacaaattcatgtgttgaaatctaatgcctaaatggtggtactaagaggtggggcatttgggtggtgatcgaatgggattagtgctcacataaaagaggcaccagaggccaggtgtggtggcccacacctgtaatctcagcactttgggaggccgaggcgggtggatcacttgacgtcaggagttcgagaccagcctggctgacatggagaaaccctgtctctactaaaaatacaaaaaagattagctgggcatggtggacaggtgcctgtaatcccaactacttgggaggctaaggcatgagaattgcttgaacctgggaggcagaggttgcagtgagctgagattgcaccactgcattccagtctgggggatagagcaagactctgtctccaaaaaaaaaaaaaaaaaaagaggcaccagaggctgccttgccctttgcaccatgtgaggatgcagtgaggaggcaccaactatgaggaagcggccctgcccagatgttgaatttgccttcccagcctccagaactgtgggtaataaatatctgttgttcataagcctcctcttctgtggcattttgttagagcagcccaaacagaccaaggcagaggcagtgcaacatagaggaagagcccagcctccaccccaccttcagcactcaccagctatgttacttgggcaagttgctaaactttcctttgcctcagtttcctcatgtgtaaaatggggataatcattgcacatacctcgtaccgctatgggcaggattagaattcaatgggtaaagtacttgagatgtacctagtacatattcaacattaaatacctgtttattattactattagttcacgggtgaaactgtaaggacctgaactggggtggtgatggtaatgacgaggaaagagggcaagagtctagcaagtgcgggtgtctggagtggggggcggtgtgtgtggagcaccagcgactgaggtttcaaactggggcagtgagaatgggggttctatgaatagaaacaggaatgtcagaaggatgagtgtattttaagacaaagatgggtgagataatgcaacctaaagcacgttgagctcttaggtaaacgtcactataatacttctgatattatgcaatgcaaatggtgagcactcaatgtatgccactatttgttcttcctgtgaggctcttcctgccaaagccctattagctacactctctgtacacgatcagtcattctgacctgagtgttcctacccggcatcgtccatgcactgatagaactccttgcactccagtataattaccctccctcaggctgtgagctcctgtaaaggcaggctctgtgcttcctcctctcccagtctccagggcctaacccggtgcctgtgcacaaggtaggcattcaacactcactgtgaacaatgttttgcacctcacaactctgaaaaagattatatcttccataaaaattatcttagtcataagcccagaattatggaaaatctatagaatcggtgtttagcagcctcagagggccagagaagtttcattaagtatgcaacagttaataaacgagaatgaaaaagttaaccgaggtgggcaacaggtgctcctaagcatagggatcaatacactttgtgaagaaagtcaattttctgtaaagcctttgtgtccatctttatcaatggctaattagataacgcagctgctgaaaaatgttaggctttaaagtccaaatgtcctcttgctgcatttctgtcctagcagacctaaagggaacagcgttcagagctgagctgtgggagtgtcttcaactgcccccaccctccacccgcgagtagaaaaaaaagcaggtgctggggacatctctgtttaaaaagcagtctttgccctgtggtcattggtaggtgcccagctgataacatttcatatccctcatccattaatgcctcaaagtattacaccaaaatttcattaaatttataatgaacccactgccttctgcccccacccccgcattagcatatcctcaggattgatgaaggttatttttctttttctttcttgagacagagtctcagtctgtagcccaagctgtagtgcagaggtgtgatctcagctcactgcaacctccacctcccagtctcaagctattcttctgcctcagcctcccgaatagctgggactacaggcgcacaccaccacgcccggctaattttttttttttttgtattttttagtagagatggtgtcaccatgttgcccagggtggtctcgaactactgagctcaggcgccttggcctaagtgctaggattacaggcatgagccactgggcccggcctgaaggttgtttttcatcacagaatcccagcctcactcttccttcccaattaaagtgctgactccagcaaatcgttctccctctatccaagttagccctcaggcctacctaggttaaatcatataaaggtgccaggcagtcattctgcagactgtcttaccatatttgggcctcagttccattctttcctgttcatccatgttatccaggatggtgtactttgtttttttcctgattttagtccttttttgtctgaaaggaacaatgaaaagctcaactcagatctttagaaaggtaactgagagctaggatttaacgcacagtaaagacactaaaggaaacattttgcctttatgatgtgatagttggcgtcttttattaaagaaacatacacaaggccaggtcagagctcagagggccattatgcatcttggagaaacacatttctgggtataaacagccacatcactcttgcccacctatctacaggtctcagctaagcctcaggctgcagtgccaattctcaacacttgtgtgttggcccagggagctcttcttcctgagtaattccttattcagaaaagcctggatgagcaaatgttcccctgaacctgtatcaccctgctatgtccaatgctgcagtaatgaaaaggtgtcatgaactagcaatcagaaaaaaatagcaaaaattataataaattcccacaattaattagcaacagctgctccccacctttttcttttttttttttcctcaacacatgaaaattatgctggtcccatgtgcctcatcctatgtacagagactatttgaaaatacacatccaaaccatgccaaggcacgcagagaacaaaatagtaatttcatagtaaaaaagcaatattctgggagcatgatgatcagaagcataggtctcaatttagcacttgctagctggtgacttagagaaaattaattgagacttttgtgcctccatgtcctcacctgtaaaatgggagtaagaatagtccctttctcacatggttgatgagaggactgaataagataatacaaacaaagcacttagccattaatcacaatggcaaatacttcataaatgttcacagttatcactactagcatcatcatcttctacttgatagacatgtcacaaagctgcagatgtttaatgccatacacagtagggtcacatatggctctgggaaaacttaacgggatttaggcctctaagtgcctgcacctggctccctttcaccagtcttactttgggaacgtaatcacaaataaaaccaaaataatctataagtgatttctgaaaaataactattaaaatacactccttttttttgagatggagttttgcttttgttgccctggctggagtgcaatggtgcaatctcagctcactgcaacctcttcctcccgggttcaagcgattctcccgcctcagcctcccaagtagctgggattacaggcatgcaccaccacgcccagctaattttgtattttcagtagaggtggggtttctccatgttggccaggctggtctccaactcctgacctcaagtgatccacccaccctggcctcccaaagtgctgaggttacaggcatgagccacctagcccagattaaaatatacgttttttaaaaatcacacctttggagagcagttacaatgtttcacatgaaagagtggacctgatgctctcttctaaggacagagggttgagcatggggttctggaagatttggccagtgaggtagcttgaggcttctcaggggtcagctccatggaaaaaggaaacacctaaagcaaaagttctctttggcggtgttattgcctcgcttacagtttcaaatttattaaaaatgattcaggtggattcgattattgctttacataatgaaaataatcaaaacctaccatttgtaacagtatacttccagaactccttcctctattgagacctgtaaggccacttaggtacttgtgagatagatatatatatatatatatatacacacacacacacacacacacacacacacacacacacacacgcacatatatatatatatatatctgtatgtatgttttcatcacagttcctggctaataactcccacggcccttgttataatgctggggcactttaggcctcagaaaacagaatctccctctctctctctgaccttctcctgccttctttcacctgctttttattctccccaaagcaagaaacttcccctgcctttctgtctcggagctggctagaaagacattctctgacctactttgtctgattataggtcataaaaccctcatttcagaaagagttctgcctcctacgaggagaatggagtgctttacagagaggctgagaagaatctggacaggccttgctgggcttccccactcagcctgttagtatcacatcataccctttttgtccaactacttttctataactatccaatgaagtcttcataaaagacccaagacgacagggttcagggagcttctggacagccaaacatgtggaggttcctggagagtagcatgcccagagagggcatggaagctctaggccccttccccatatctcaccctatgcatctcttcatctgtatcccttgtaatatcctttgtaataaataaccaatgtgtttccttgagttctttgagccaccctagcaaaataactgaacccaaagagggaattgagggacccaatttagagtcagtcagaagcccaggtaaaacgacctggggtatgcaactggcatctgaatggggtgggcagcagtcttggggactgagtccttaacctgtgggatctgacgctatctccaggtagacagcggcaaaagtgaattggaggacacccagctggtgtccactgcaaagctgttgcttgactggtgtgtgcgaagaaactcccaaacaatggtcacagaagtcttctgtattgattgtggttgagtgagaaaacagtaccactctagtgaatataatgtaagactgatagagaataacattagatatgatacagaatcgttgaccctcctagaaaacacaagagctgcaatgagaaaaagctgcctctaatattccatttatttaggcacttatgctttgtggcagaaagtgcattattataataaacagcttagtggtttaacaagtccaagtaaacaattcctaagctgtcaaaacacacttagtgtagggtctctatttcccaggaataagcactctaggtaccttttgcagcagcagatgcaaagccaagtgaaacctcctgttagcacaataagagtaaaagccaacactgtcacatagaatatactccactctgaaacacaagaaaaccaaagtggacatagttacaggctatttgtagaacaactttattttgatgattcataacaactatttctgaatccctacaaggaaaggccacctgtggagttgataacatcagactggtagcagagcagagcaaggtaaaatacagataaatcaagaactgtaaaactaaaactgccctgtttttatctattgggtttcagggcctcacggagcacatatttcatgcgaacttgggaacagaataatctgaaataactaaaattagtcaattacatagtaatgcctcttatataaacacacatgtataccacatcaaaatattcattccagaatgccaaaaatcacaacccctacccctgaaagttctggcttggttttaataaagcatctatatggctgtttatggcatgaagacatttttcacggccagagagcaattcagaaactacttgaccctcattccttccacatccttacagaaatctaacgtgaaaagctttcaacagtaattcagagacagagaagcccagtttaaatctactagggagcaaagtttaactctattaggcagggtgcggtggctcacgcctgtaatcccaacactctgggaggccgaacggggcagatgacttgaggtcaggagtttgagaccagcctggccaacatggcaaaaccctgtgtctactaaaaatacaaaaattagctggacatgatggcacacacctgtaataccagctacttgggaggctgaggcaggagaattgcttgaacccaggaggcagaggttgcagtgagctgagattgcgctattgcactccagcctgggtgacagagcaagactccatctcaaaaaaaaaaaaaaaaaaaaaaaggtttaactttattaaatgttatataatttcattggaataatgatccaagggctggctattttctgatttttatatagtattaaatgggaatatactttggcagtcagctcttactatccttggtgccaattatgtccatctggttccccaaacaacaaatttacttagtagactgccattaaaatatagttttctccccagaaggggcaccagcttgccctgctgtggctccagtttttggtgcctgcctgtgtgaacagctggaagagtgggccaaattctcttctttacctgattctagaagatccataccaggggccacttcaccagaaaatcacactgagcctaagccaaggcaggtgtaacctggaaatgcagcccgtggcccaagcaattctttcttagaaatgccagcaatagtgagccaattctgctctgccaaagggaattttctcattaggaagttttatgtaaaagcctaaacacatcccacaaagtagattgtaagaagggtcttaacttactaccaagtgagctggttcacttggcttcaggtgagaaaagcactgaatgtttataactgcagagctaggcagatagttctctttttctatcttttctcttttctttccctctttccctcccttccctcccctcccctcctctgccctcctctcccctccttccttcctttcttccattttttttgagacagggtctcactctgtccactcactgcagactcaacttcctgggctgaagcaattgtcccagctcatcctcctgagtagctgggactacaggcacacgcaaccacactcagttaattttttaagaaagggtcatactatgttgtccaagctggtttggacctcctctcaagcaatcctcccacctcagcctcctgagtagcagagactacaggcatgcatcaccatgcctggcttattttgttatttttttgtaaaggtgaagtctcactatgttgcccaggttggcctcgaatattaggcagatatttctgatacctgagaatgagctgccttaaggctcctcacccaaagcctcctctataccagaactcaccacagttgctctctccatcccagatataacgctgtataaggttctccatccataagtgagagcaaatgcagcgctttgtgagggggtcgcagtgaccatggccagaacacttcagaaggcaacctgcaaagaggtgtgtagggctgagggcagcatgcagaaaagggaatccctggattcagcttcttttgtatcttcagtagcataggtcccaaataaaagcatcttgttgaattaagagcctcttacagtgtggacaggggttctggagatagtctctcatcactgacaatctcatcagaaagcaaatggcagaaaaagccagtccacaccacgcagcaaaagccttaaaaatattgggaggccgaggtgggcagatcacaaggtcaggagatccagaccatcctgaccaacatggtgaaaccccatctctactaaaaatacaaaaattagctgggcatggtggcacatgcctgtagtcccagctactcagggggctgaagcaggagaatcacttcaaccagggagttggaggttgcagtgagccgagatcgcgccactgcactccagcctggtgacagagcaagactttgtctcaaaaaaaaagtttactggctgggtgcggttgctcacgcctgtaatcccggcactttgggaagccaaggtgagtggatcacttgaggccaggagtttgagaccagcctggccaatatagcgaaaccccacctctactaaaaatacaataaattagctgggcgtgatggtgtgcgcctgtaatgccagctactcaggtggctgaggcacgagaatcacttgaacccaggaggcagaggttgcagtgagccgagatcacaccgctgcactgcagccggggcaacagagggacagagctagactcaaaaaagtagcaaaaacataacattgtctggcctaagaaaataattctaagtatttatctggagtgcaatggcaattattgaggacatgcccaaagatttatctacattatagcattatctttaaaaccaaccctaaaacccatggataagaaactggttgcataattatggagcatatccagggtagaatactatgtggccataaaaattttattgaagagaaattttaaaggattggggaacataatcataatatactttttttttttaagagacaaggtcttgttgctatgttgctgtggctggtctcaaactcctagcctcaagacatcctccctcctcagcctctggagtagctgggattacaggcatgtgctactgttcctggctcataatatgatttgaagttaaaaatcagattaaaaatatatatcatgtcatcctgattgtagagatggtggaactggaaaaacatatatcagagtattaataaaaattttctttggatggtgagaattttggacctagaatttagagaattattttcctctttgtgcctctctggatattctaaattttgtacaataaataaatattatttttgtagctagaaaaaaaaaggagttattggctgggcgtggtggctcagcactttgggaagctgaggtgggtggatcacttgaggccaggagtttgagaacagcctggccaacatggctaaggctctactaagccatgatggctaaggccatctctactaaaaataccaaaaaaaaagaaaagaaaaaaggagttattaaaaattaagttactccatattataattgagaaagtcaattgtagatggatatatatatatctagatagatagatagatagatagatagatagatagatagatatctgaaacaaattaaattttactgcccaaacattatcatttcccttgtaactctcatttccctggagtctactgaaataaccacttcaacataacaagagattcatgttactcatgaaataaagatagaaacaatgggactatgaatcatttgagtaccctggaaggggtggtgagcatggagctaagaaaagaggcacacctggagaaggcatttgcaagctgtcttaaattttcaaggagctacatgacattatcatcacaacctaaggcatgatgtccaaggtaaataaattatataaacatggcttttgcagccagtaacacttatttgtctttaacactgttctttctgccaatagccattatcttgtgagtataatcttaactttaggcccataattattattgttttccatttttcttccaagaccaagagtagttggcaaatgcatgctgcaggaaactctattggagaaataaatgtaaaacaagtccctggatgctaaagtgaaaatgttcacatgtcactcctcttctatgtttgtcaaacttatccatgattggcaagtctgattgttttagaatattccataggagacctacctgctgtatcaaccctcaagaccttgaaaagcaagaagtcagccttctcctttgagagccgcatgtgcagatttcgggccacttcagcagctttgagaaccttgaaaggcggcctgctctgtacataaaacacaatcacggtgctgtggaggagacaatgagagaggacagccacatggtcagatggtgactaccatgacacgcccaccacagcatctgacctgtgaaactggggaggtagacggctacagctctgtggcttgccaaggacaggggcgtatctgtgagccaaggaattgatgtttctattcacaaagcctcttcagtctcaacgtacagctgatcaaagacagacagatcttcagataaaagaagcaatgtgtaaattatgtatcagtttttgaaaatcctaaccaaatgggtctggagagctatcaggttagtgaacaagaatgcatctatgtgctgggatgtatgaagtgttacatccatggggatggaagctcccatgcacaggacccttctagatcttgccctatgtaccttttcatctggctgttcatttgtatcctttaatatattctttgcaataaatccataatagtaaaaaaaaaaaaaggagcaatgtataaatgtgtgcaaaaagacaaatatacacaaaataacttgcagacatgtctttctttttacctttttttgattgagatataacttacatatcataaaattcacgcttctaaagtgtaaatggaatggcttttagtatattcacaaagttgcacaaccatcaccactatcaaatttcaaaacatcttcatcaccccagaaagacaatccacactcattagcacctcctccccacagtcccgggcaaccactaatctgcttttggtctctatggatttgcctcttctggacacttcagatagatggaatcatacaatatgagaccttctgtgtgtggcttctttcacttaccatcatgttttcaaagttcatccatgttgtagcacacatcaatactttattcctttttattgccaaatgatattctgttgtatgaatatatcacattttgtatccactcatcagctggtggacacttgagttgcttccacattttggctattatgaatttgtgctatgaacattcatatacaagtttctgtgtagacataagtttttcatttttattgagtatatacctaggagtggaattaatgggttatatggtagctgtatgcttagcatattgaggaactgccaaactgtattccacagtggctgtaccattttacatccccactagcaatgtataaatgttccagtttctccacaggctcgccagcacttgctatggtctgtcttggattctagccatcctagcaggtgtgaagtgatatttcaacatgggtttggttggcattttcctggtggctaatggtgagcaccttttcatgtgcttattggccatctgtatatcttctttggagaaatagctactccaatctgtattcatcccctagggttgctgtgaaacacgtcccacgaagtggcttaaaacaacagaaacctcttctcacagttctggaggccagaagtccaaaatcaaagtgttctgttagctctggtgctgccagcaatccttggtattccttggcttgtggaagaatctctccagtccctgcctcggtcgttacatggtgttcttcctgtgtgcctctctctatgtctcttgtcctcttcttagaagaacaccagtcatattgatttaaaagcccaccctactccagtataacttcttaactaattacatctgtaatgaccctatttctaagtaaggtgacattcataggtaccagaggttagggcttgactatattttggtggggggcagggggtggatataattcaacccacggcaagtgtttcatcatgaaagggtgttggattttgtcaaatgctttttctgtgcctattgagatgatcctgtggttttgtcctttatcctattaatgtggtttatgacatttattgatttttatatgctgaaccacacttgcattcctgggataaatcccacttggttatggtctataaaccttgtaataagttgctggattcagtttgatagtattttgttgtagatttttgcttctatattcacaagggatattggtctgtagttctcatttcttgtgatgtctttgtctgattttagtgtcaaggtaaaactggtcttactgaatgagttgggaaatgttccctcctcttctattttttggaagtttgtgaaggactgttcattctttaaacattttgcagaattaatcagtgaagccatctggtcttgaattttgtggaaagttttaacattactaattcaatctctttatttgttataggtctatttagatttttaagttcttctcaagtgagtttttgtaatttatgtctgtttaggaatttgtccacttaatctaggttatctaatgtgttgacatacaatgatccataatattctcttataatcctcccccacccacattttttggagactgggtctcattctgttgtccaggctggaatgcaatggtgtgaacatggctcacagcagcctcaacctcccaagtgatcctctcacctcagcctcctgggtagctgagaccatgggcgtgtgccaccatgcctggctaattttttttttttttaagatggagtctcgctctgtcacccaggctgaagtgcagtggcgcgatagctcactgcaacctctgcctcctaggttcaagcaattatcctgcctcagcctcttgagtagctggaattacaggtacctgccaccacacccagctaatttttgtatttttagtagagacgaggtttcgccatgttggccaggctggtcttgaactcctgacctcaagtgatctgcccacctcggcctcccaaagtgctgggattacaggcgtcagccaccgcacctggccacctggcaagttttttgtggagatagcatttcgccattgcccaggttggtctcgaactcctgggttcaagctatctgcctgccttggcctcccaaagtgttgggattacaggtatgagccactgcatccagccctttttatttctataaagtcagtagtaatgtgccttatttcatgcctaattttagtagtatgagtcttctctattttttcttagtcaatctagctaaggatttatcaattttgctgatctgtccaagaaacaacttttggttttgttgattttcagacatgtctttgattcagtattttatattttacgagggaaatatatgatccattttagaaagagttccttagaaaataattagaacatgtttaaatttggtgtttttctaagtgaacttcagttctctggaaaactaaccaaagtggaagagctgacaatagctaggcaaatggagttactgtgaatagtgggttttcattcccatattctttttctccctcctcccactccaccctgagctagataagactttaaaagtaaaattcagccaggcatggttgctcacacttataatcccagcaccctgggaggcctaagtgggcgaatcacttgaggtcaggagtttgagaccagcctggtcaacaagatgaaaccctgcctctactaaaaatacagaaattagccgggtatagtgggggcaccagtagtcccagctactcaggtggctgaggcaggagaatcacttgaatctgaaaggcggaggttacagtaagctgagaccatgccactgcactttagcctaggcaacagagcgagaccctgtctcaaaaaataaaaataaaataaaataataaatagattaaataaataaaactcaattaaatacaaagatgtcatgaaaaataaaggccagagtttcagcctcatatactcccaggagatggcaaatggtaatcagtgatcctttcacattgagagaagcctcagtccccatgaacgtggggcagggatgcagcccagctgtgagacatcctcttcacatgctccagaccccttgcccagctctgaagacaccagagctaacaaccgtctcccctgctgttccccagcacctccttcactcagaacattcccaatcagcaaacatttactgagaattttaggaaggacctagcatgatgttggccatactactgccctttgagaaaaaaagtatatgaatgggataaaagtgtgtcaaaaatacaaaagtagcagaggaatgaacagttttctactggactgggatgaggtaagagctggaattttgtacggccaaggccccgccttgagtgtgcagctcctacctgagatccgagtgggcccgaatcttctggaccttaatgtccgagtccagcacgttcagcagcacagccagctgcctcacaagggtgtccttccgctgctctgtcagctgcccaacaccaacctgcagggtcagctccaccaggccactcttcctagggtctggggaaagagaagatacaggatttgcacttggacatttgcacaggctttagagcataaggagcgaggtttctataggagctcaaagttactcctatgccatttctacatttgagttgtagcactcaggtaaattcttctaaacaccgcaaaggccactatctgggagtactttcccttgttttatcacagtttgttgtttataattttttttccagaagataatcgggtgtacctaattagcctctgggctagctgaaaatttcagcctcttccacattttcccaggaccagaaagagaattttgcttccaagtgccaatgggcacttcccagtccagtttatgctgaggtcgttacagccacttcactggagctgcctccctctgtgccctggtatgaggcccttgtgtccacttcacattaagtctttgtcttctggcaggaaaacaaacatgaaaagaaaatctagttgccagataacattctcttttaaagagtgatgaggctggatctatctggggatacacaacaaggtgtaagagacatcctcaaagtgggtccagccaagagctggagccagccacaggaggcctcccacactggtcacatctgtcagcgtaaagaccccaaaggctgaccagccagagcctgcatggccagctccagagcccaggaactcacctggctgcacttccacagtggcagtgtctgtgtccgaggccccctgactgtcggtgactcgcaagtggaaagtgtacaccccctccaccagattcgtaagctgcagagccacactgtggtcagagccatcgatgacatcctgcgaaagaacacggatcacagggcagctgtcaatcctcgggtcccaatttctgggcttctgttgatcctaaacctcagtgtcccatctttttaacacaggcgtgactttaagagggaggctgcagggaatgaggctggcgggatagctaaagactggagaaatcctcagcatctcttccccaaaaagcaccagggggcacatcctcagacagtatttcctgaactgaactaagtttaccaagcactttccaggaattaccaaataattaattgtatccaacaaagggaaagaccatttgaattagggcaaggacgctgagaacaaagcacaggttttctgggtcttattttcaaacatagctttacaaaactctcatcttgaattccctcataatgtatcatgttcacctgaaataacccaagaccctgtgtagcgtcctctgttctgtgggcttctaagctccaaagaatgagagaagaacctcccagactcctgctaatagaaggggtgataacgaatatgtgctgtgaacagagactcattgttattacatttagaggctaatcccccatctagttgaatagtgttaattctagaagtgcttagaaagtataaagcatttggcagggcatggtggctcacgcctgtaatcccaccactttgggaggcaaaggcaggcggatcacgaggtcaggagatcgagaacatcctggctaacaaggtgaaaccccgtctctactaaaaatacaatacaaaaaaattagacaggcgtggtggtgggcacctgcagtcccagctactcgggaggctgaggcaggagaatggcttgaacctgggaagtggagcttgcagtgagcctagatcgcaccactaaactccagtctaggtgacagagcgagactcggactcaaaaaaaaaaagtataaagcattttcagttccttccctgtgaccactccttagtacatctccaagactaaatctgtatctctccagtccttagaaatggcaggaatgaagacgtacatacatttatgtcctaagaggcagagtgatctaatgggggtaaaatgcctgccaggagctaaaaacctaggtgtgtctagtttgattaaaaatggattagttaaggctgggcgcggtggctcacgcctgtaatcccagtactttgggaggccgaagcgggtggatcacaaggtcaagagatcaagaccatcctggccaacatggtgaaaccccatctctactaaaactacaaaaattagctggacgtggtggcacgtgcctgtagtcccagctacgcgggaggctgaggcaggagaatagctcgaactcgggcagcggaggttgcagtgagccgagattgcgccactgcactacagcctgggcgatagagtgagactccatctcaaaaaaaaaaaaaaaaaaaaaagaacaaaagaaatggattagttaacctcggccaagtcacttctcatctctgcatttcgccttctgcatctataaaacgtaaatagcaatccgtgatctattgactcatctggtacaatatgaggaacagaaaagaatccacttggaccaaaatacgaaggatggaaaagcatcctgctggaagacttgacctcaaagtgcttccaagctatggtttcctgccccatccaaagtctgttcaggaaaaagtcagaaaggatttcagcttttggctaaatctcaaagcagcctactgcctccagccttcagaacattctaatgtagaagcataagcaccttacagggaacagggaaagagagatgaggtcattatagagacactgccgtggaccgaactgtgtctttcccagactcctgtgttgaagccctaaccccatatgactgtatctagaaataggacctataaggaagtagttaaggttaattgaggtcataagggtaggcccctgatccaataggatttactgtccttataagaagagacaccagagtgctctctcttcccctgctatgggaggacatggtaagaaggcagctgtctgcaagccaggaagaaagacctcactggaaactgaattagccagcaacttgagcctgtcttcccagcctccataatggagacaaaattaagttctgttgtttaagcctccttatacttatatcctttccttagaatataccgtgatatattgtttgcagcccaagctgactaatgcagatgtaatgataagtggtctaggagcaattctctctcagtactcactccagctgctggactctggccatcccggatccacagataggacacaattctttggtcatcagtagaccttgaaccatccaaagtaatggaattattgggaagcacaagaacatgtctgccaccagcccgggctctgggaggactattattttctaagtcaaatatagcaaaatgaaagcaaagagattgatttaaaacaccagtgatagaataagtgtgtcataaaacatccacaactcttccaccttgcagatacagtatgtagaattaaaatatccaaaaaggcatttttttccccagatgcatataagatacagacttccttaaagctccatttgtacttagttagctataatttgggatgaaaacggtaaagcaggtggcaagctgtaccttgggaatttttctaatattgttataccttttctgtccttgaaaaatagaaacaatgattttaccaacatttagggtattgaaagtggcaatattttggtttacaatatactttgggtcattttgtactggtccacactatctggccagaaatatttccacttcaagtactgccaaatcttgactctctaagacaaaaaaaaagaaaaaaaaaatttgagtaaaaagtaggctgggtgcagtggctcacacctgtaatcccagcactttaggaggccaaagcaggagaatcacttgagaccaggagtttgagaccagccggggcaacacaacaagtctccatctctatgaaaaattaaaaattgaaataataacaatgataattaggccctcacttctctgactaggtgttaaatataaatgaggcaatggccaggcatggtggctcataactgtaatcctaacacttggggaggctaaggcaggatgagtgcttgaagccagaagttcaagaccagcctgggtagcaagacccgtctccacacacacacaaaattaaaaatcagctgggcatggtaacacacacctgtagacccagctactcaggaagctgaggtgagagaatcacttgagatcaggagtttgaggctgcaatgagctatgatcacagcacagtactccagtccgagcaacagagtgagaccctgggtctattttaaaaataaaaaaatgaggcaatgtaaaagccatttctgatgtaataacttcagaaaagaggggccagggagcactaacaacactggggtacagtggggagatcataataagacacagcctcaatttggagatgaggctgctgtgaggcaaatcctgcttgtccagaaggggctctgggacccagcctgatccctcccaatttccccttagaaacaagtcaagatgcctgttcagactattctctctacttttatgcatggttgaaaatctctacaataaaatcttttgaaaaatccaaatctatatcactttgctgttaaagttgcttcagcctctcccagctgcccagaggataaagtccaaacccctaagcatggcccgtggcacatacaaccctccatggcagagcctgtgcctcaggctgcagccactctcccagcgtcccacactcttgccattctacaatgcttgaacctttccatccagccaggctcttatactcctctgcacttcaacacgttgtaatcatccattcactaattcattcaacacctctgatttgccatgagtctagcactctgctatactgaggctatactgaggatacagagatgtctgaagcaaagacactcaggcagttcacagtcaaatgggaagacagacaaggagacaagtacctaaagcagtattcactagtctagaccacagatttcacactaagaaacgatatggaatttgaaaacatctcttttcttgaatttccaaggaataaaggaaaaaaagcataatggtgtcatttggacgtgggtctttcattactagtagtcacagaagagtgaagtcattagaagatatgctccacaaacaaaaggaaatgtctgcttgcagagggcgactgagaaacagctaacatgaatagaagaaagttggctttttttcagccaggcagggttcggcatctgctgcgaacaaataagcaaacaccaacatctctgaatagtcatggcctggctgagggtcctgcagactcgaaagcagagcaggcccagccctgtccacctcagacccactcacccttcttcacagccacagtgagggtggacgtgctgctcagtccctgctggtctttcactgtcaaacggaagtggtaggtccccacctggagaccagtcacagtggctattgctttgtcaatattttccatctccactgcactggggcctctataaaacatagaagtggttaacataagggagggggcatggggttttgaatatgacaggcatgcgatttgtgctcttataaatgttttgttccagctataatatataccatttagagaattctaagaaaactccattcatctgtactctctagttcagtgtaagagtcacaagctaaaacctatctcaggcagagtctgctggattactgggaagagaatatttgttctcgatttttttaagtcaagctgccagtgaaatgatctatccttggaaaatgagccttagaaacgactcccatttcttctttgaataaaattaggtgaaatcctcatctatctttagggagagcatggaagaggagggaataagccagataagccctctcctaggagagagatcacagtatagtcactaagatcggggcttgtcaaaaatacctcagtttgggtccaagctctttctcttactatctgggcaaccttagtctgtgtggtctcattagtgtctacaagcctcagtttcttcaactttaaataggaataatattcttatttatctcttacaaactgatacagggttctatgagacagagcatgtaaagctcagaaaatgttagatgatatgggtcgccccttacactgcacttctggtgtctacagtcactgcaggatgggttgagtgtagacaggatcacacacaggtttccctgaacctcttctgtcatgagctcgcctcacaccaagacagccctgttcaactgccccaagctctacctccctccgctgtcaatgatgtccatccacacttaatgtactcttcaatcaataacgcccagccacttctagaaacgtgcttaaatcccgactcctcaaaatgcgcaagctgattgtttactacagatcctccagagaagggataatattagcattcagcatgggcatgaacctagctcagtggcgagacagactacctgacgtgctcccagtggtagaagacaatgccgtggtcatcgctgctgctgctcccatccagggtagcactttccactgggaagatcagctctttatcagggccggccacagccactggaggtctattgttttctggaattacagaaacagtgtgaaaaagtattatctctttgcattaagtctgcaatcctgtgatttcttgatttaagtacattactcatcttcagaccaggcagccactagagtatgcagcatcctttggaatcctggagtgaagcactgcagcctcctagctgatccaggagttgaacagtccaagttcaagactgctgttataggcagccaagaaacactgtctctaatagacacatctttggtttatttggtttaaaagatcctcagtcggccgggcacagtggctcacgcctgtaatccagcactttgggagaacgaggcgggcggatcacgaggtcaggagatcaagaccatcctggctaacacggtgaaaccccgtctctactaaaaatacaaaaaattagccaggtgtggtggcaggcgcctgtagtcccagccactcgggaggctgaggcaggagaatggcatgaacccgggaggcggagcttgcagtgagccaagattgtgccactgcactccagcctgggagacagagcaagatccgtctaaaaaaaaaaatcgtcatagggtgaaagagaaggaaaggaaagaagggtaaaatgagagagggaagaagggttgggggaggaaggaaagagagaggaaggaagggagggaggaagagagagagggagggaggggacaaagggacatcacagagagggagggaggggacgttgatgtgaagagacctgctttatcaggtagggcttacttccttttgtctctgtagcctcagtgctaacacagtgcctggtaaacagtaaatattcaaaacattttaaattaaatgttaaacaaaagtaaaagatataaagtattgctgatattggcagggcgtggtagttcacgcctgtaatcccagcactttgggaggccgaggcaggggatcacttgaggccaggagttcaagaccagcctggccaacgtggcgaaactctgtgtttctattaaaaatccaaaaattagccaggcatggtggcacacatctgtaatcccagctattcaggaggctgaggcactagaatcatttgaacccgggaggcagagattgcagtgagtcaagatcatgccactgcactccagcctagacgacagagtgagactctgtctcgagggaaaaaaaaaaagtattgctaatattgatataaatagataaaatatgtgtaaaccaaaaaaaagggccaggtgtagtggcttacacctgtaatcccagtactttgggaggccaaaggtgagagaactgcttgagtccaggagtttgagaccagcctgggcaacaaagtgagaccctgtctcacaaaaaaaaaaaaaaaaagaagtcatgtagtcaaaagctgtggcagccattacccaatgtttgcaccacgccacagcccccatgatcctactcactacaaaataggggtttccctttgccgtaggatagagtacttgggtgaccatacatttacaaagccctttaggatggtgccccgggctctcttggggtcatctattgtcattccaatccctgcccaacctccccaccacctcccattcccacatccctacctctttttctctctctccaatcacagtaattccttttaaatcttcgaatgtaccagactctcttctttggcgcccacgcatactgttccctctgcctaagaactcttcctcttctcctgtgctgcccacccctcccattcttcaccgactaactgtgacttgtgcttcaaccttgagctcatgtacgagctctttgcagatgcatctcacccaggtgagtgctctttctttggggtcctgtagcaccctgcagttattttagtagagcgccaatcacagagttttatgtgaacttctccataagccctgcaagggcagagatcaagtctatcttgtttaattccacatcccagggtctaactaatagaactttttatgtattagcggcataaataaataagttgtctataggttgagtataatctcattgccaggaactggatagaggttcttggactaacagaactcttctagaaaagttctaaggcaaagaccattatcaaacaaaggtatagctacctttaaggttatttaactcaggaggtaggcagagccctgggttttcatgaaactattaatgaacagtgacactgaactgcaacgtgttccccaatgtctggctacatctgagtgtcaagccacacataagaaccagccccttcaagatcccctggagctctccagagcagactggggcacgtgtggaagcatccacaaggcaaatcggagcccacaagcagtgctgtggatggctctcatttcatccttcatgccatagtttacagtcaaggcaagatttagaaccttgaaatgaaattagttttatatggagctttggcacccacaggccggtaccaccaagtgtggcatctccaaaccccagaagcccagctatcatttctgctttaatctctgaggccaaatctctttctcctccacctaccaggctggacaatcacagtcaccacagcagtagactgttgccttgaagaatctgtcaccttcagctgaaatgtataatctccttcctgcattgcagataaatgaaggtatggcgtctgtactccctaagtaatagcaaatacaaaaataaaaacaaaacaaaacaaaaaagtaaagaagcacaagtaaatagtatgacagaatgaaaaactaacaattttacttaatacagagatcttgctcaaaaaagaaatgtgtttggccaggcacggtggttcacatctgtaatcccagcactttaggaggccaaggcaggtggatcacttgaggtcaggagttcgagaccagcctggccaacatggtggaaccccgtctctactaaaaatatattttaaaaatcagctgggcatgatggcgggcacctgtaatcccagctacttaagaggctgaggcacgagaatcacttggaacacgggagagggaggttgcagtgggctgagactgcaccactgcactgcagcctggttgacagaaaaaagaaaaaaatatgttggtccccaggaaagtgcaactgaaagtctactgtgcatcctcatacactattgaaggagtgtaaactaccataggctttttggaagccagtatgaaaacagctattaaaatattaaataagcacatactccaacccagtaattcgacttcttagtatctaccccagagaaatgcacaaggagactcgtccatggatgctgactgaagaacagtctatcacagcaaaacatggaaacaatctacacatccatcaacaggaggatggtcaaacacactatgatacactgtggaatgctagtttaaaagaaagaagtttaaaatcatgaggcaggtttataagtactaaaatggaaaatgtcaaagaaatattaagcaaaaaaaagaaagttgggtcgcattcaaaagcaaacagtaaaaaaatttttaaagaaatccacacaaaaaagaaatttgtggaacaatgcatacaatgtgaaaggtattgctacatgtacatacgcacacttacacagacacatggaaaagattctggaagtgtacacattaaactgataaaagtaattatttccaataaggacacttggatgacagtggtgatcaatttatttgaacttattttagcagaatttatttgagcttttttattattattttttttaaccacaagaggcaattcatgtattagttttgtaatcaaaaataattttttggctgggtgcagtggctcatgcctgtaaccccagcactttgggaggctacggcgggtggatcatgaagtcaggagttcaagaccagcctggccaaaatggtgaaaccccgtctctactaaaaatacaaaaattattcgggcgtggtggcaggcacctgtaatcccagctactcaggaggctgagacagaagaatcacttgaactcagggggtggaggttgcagtgagccaagatggtgccactgcactccagcctgggccacagagtgagactctgtctcaaaaaagaaaaaattaataataataaaaacaactttttgccgggtgtggtggctcatgcctgtgatcctagcacttagggaggccaaggcgagaagatttcttgagcccaggagttagagatcagcctgggcaacatggcaaaatcccatcttcacaaaaaaaaccacaaaaattagccaggtgtagtggtgtgtgcctgtggtcctagctactcgggaggctgagatgggaggatcttttgagcccaggagatcaaggctacggtgagccatagttgcaccactgcactccagcctgggtgacagagtgagaccctgtttcataataaataaataatataattttgtaaaactctaagtcaacctaagtttttacaaagtcattttttcaactgagtatgcaacagctacacttggtgacctcaggttaataccctttcttttttgtcgttggtaataatttcaattattgcttatgtttgaagttcatggcatcatgaaatggatttttaagtcttattacaatttatttacttttatagatcccaagattgtctatagataaatgtttctatgtgtattttttaaggttttaatggaaaatttaaaaagaaaattgttacaagatccattgtgctaccaggggaacttctgaaatttgaaatgcacccttttaagaacttttgaaaaaaaaatactttcccctactttgactaagtaaggcaaagcacgtttctctgaaaagttcaacagggaaagtataatttcccaggagttgcctccaaattgatctggtacgagaatgcttctgcacacaatggaagggaatgttgtggcaaatgggaactgagcagactactgtgtctcaccaatgccctcaaggcggccacatgtttcaggcaattgcaaaggtttcacttccttcccagtaagaacacagcctcagcaggctgcttggtacaattttcagacaaatataaaagggtctgattcacagacctcattttgtgattgccccagttaatactcctttggacatcttaatcaagcttaaggcaataaggttgttactgtggatattcttcggggaaagaagagagagggtgtctggcaactgggctggtgtgtagaggcaaggctcacagtgtggcccagccctcaggaactttggatacacatccagtatgcatggatggattttggagtattagctttggatgcataattcctaataattaagtaaaagaaaattaggaagattttttttaaccgtgaaaataaaaaatatcccatcttcctgttttgtatccaacccgcctctgaatcagaattcttaacacaacagaagcaaacatagcacttgctacaacccttaggtagagatggacaccaccaagagggttctccaaggatatccagacaactcatggctctttcaagttccataaatctacctagtcacttttaactcctcataattgcaaggcatgttccaggaacactggaaagcaaagcaggtaagtttccatggaatgtccgattttatcttaaatactaatgagaaatgtatcttggactggtgaggcaaaatttgaaggagaaaaggaagatggaaatgtaaggtcctatcttttttttttttctcatgaaactcaaataataacataacttcaaaaacaccaagctggttagcaacaaaaacaaatagctttgccaatcacaaaaagaagaataagcaaacagctcacacacacaacagaagtttcaagattattatgttgttagacaaatatatttaaaagatttgaacaaatcaaaaggtagatacaaacaaggtcctaaaaagcgaccagtggatgtagacaagataacatggagtttctataaacaggagaaacagaataacaaaaaaaattctgataatcaggtttagattagattatttctaaggtttctcccaatacgaaaatacttctctaacagatgtgagacttttcccaaaccgatctcaagatctaattttcagcacagagccaattggttgctgtcctgtgcttatctaagtgggcgaggggaagggatgtaaacttggaagatttgtgagcttaggtccttttctaatagttgtaatagatcagataactttacaaaataaattatctaaatttaactgcctaccccaaccaatagcacatagctaggtagacagacagacagacagacaaaagtctgaaggcaggatggagaacttgcctgcatgaccacatgtttgccctcactcccaggacccagggaccactcatagaggacaatctggtgatcgtcactgctctggtttccattcaaagtgatggagttttggggcaaagttatggtgtgatttggtcctgcattagcaactggtgggtagtccacagcattgttcactattagggctgcagttgtagagttagtggctccgtccgagtctgtaacagtcaacctacaaaaaggagaagaagccgtagttggaagaatatgccaggctgggtgcagtgactcacgcctgtaatcccaacactgtgggaagctgaggtgggaggatcgcttgagcccaggagttctgagaccagctgggccatagaaggagactctgtctctatttaattaaaaaaaaaaaaattagccgagtgtggtcatgcacacctgtagttctagctacttgggaggctgaggtgggaggatcatttgagcccgggaggtcaaggctgcagtgagccgatattgctccactgcgctgcagctcaggcagcagagcaacagactgtcacaaaaaacaaccaaaaaaaaaagaaaaaaagtagacaaaaaaataatatgccaaatctcaaggtaaacttaggtcaatttagtctgctcatggaacagttctcggaacaggtaaaaatagaaatttaaggatgaagcaaagataaacacagacttgatatttttgtttgcttttgctgctgttggctatttttagttttagttcataacatattgatgtcagagtttcacctttatggatttctgattagcttttgagatgctgggtgaagaaaccatcctcacccaacacagatgccactctcttaacggagactaaaaatggatcaggtttaagttctgcctgcaggttgagcatgcagagacagcaaatcactcctgaattttcagctacaaagctttttactttttaatccttttctagaggacttataattatgttttcaggatactccttgcaaagcagtgttaggattaagcactttcaaatgcgaaccaatgctcaacctctgcaaacaaaaaagagaagtgcgttaactttcctgcactaaactgattcctaatgtggtcctgaggacagtgaattcacaaatgggtcacttcatccttctacgttaaagatggtggtgggagcagtgatgagtgctaaataatatcaataggcatatgacaatgaagctgtggcaagaatgcaggccttccttgcagggaaaagacatgtagggggcacctgtgcattctgagcttccttccacactatccctcatactccacacaaccaagatccaacttctacttctggctctgacagcaaaccaaacatctaaagtccttccttctcaaccaggctgagtcaggacactttttgggcccgttaggaaatttcttcatgggttagcagcagtaagctgctccaataagatggtaaagcgtaattaaatacaaatgaattaaatgaatctcataaagtacctttcactatatataaattttactccaataaataaataaagttcctattaattgatgaggatatcagagtctccagcggcatgcaaccaaaacccccatgaaagccaaatctcttttgatcaaaataagaagtgcagtgttttatgtgcgttaatttaaagaaacagtcaaaatgtaagtagcaggcagcacaataaaggcagggacccacttgcctgaaactatagttaccaggatcaaggttagacaagcgtaagacgggagagtcaactgaagtcttctcttctatgaagggcccgtttatttcttcccaatgataactcactatttcagtatcatctgtactttctacaagattaagaaataaagacaagaatgaaatacaagaagaggaagacataagttttatactttaattattgcatatttaaattcatttttataagaaattatgtacttgcctagatctcaatggatatatactgtattagaaggagattctttcctactcccgaaattatatcactatttttctcctggatttccaccagatttgaatgaggctgttcccactcagttgaatatttaagaagcacagtgacagatgcttttgcttttaaaaaacaggagtcaacaaaatgcagcacatggaaatgctacttctgctcacctcagctacagcatactgatcattttaaataggcacctgagctgacaggttcaaaaagacttgagttgcctttctacaacttacaaaacatcttttactaccttaattattaaggggtaaatccagagaaagctcacagccttacatgaaaatcttccatttctactttaaaagagaacaaacataatgtgccatgcagattcatagaaatttagacctggaaaggggctagtttcatctaattcatttaaggaaagaacaagttcatgtgacagattaataatcctgaacagtttcctgtaaataagccatactgaattagaggaatcaaaatgtgacctatttggtcatgtaaatatttccatttaaaatatgctttattttcatggtgctaagatggaaatatggattatttttgagtagatgcaaatggtcatgtcaatgtgatctctgtaaatttgcaggcttgcaagatagggcagctttaatggctaacaagtattcttcttccaacaaccaaggcaaccgttcttcctctaaaggatttggtattaactttgtgattaaatgtacataaaatgcaattacctgttacactgataaggttgaacctagtcaaccacaggatgttttcaacctattcttatttacatggacacctgtagttaacacaggggccccttccacatatactcccatagaagaaacgatctctgaatgaattttaaaaaaccaccacgctccctcactgaagacatcccttctaagagttcttaaaagtgattttcccatctggtggggggcacctcccctcccaagtcaggtcacgggagctcctctatataaagatatatatatatatatatatcttatatatctcatatatatcttatatatctcatatatatatcttatatatctcatatatcttatatatctcatatatatcttatatatcttatatatatatacatatatatatacacaaagtgattttccaactgctaaccatatataccacaccagaaggagattcttcaataattgctctaattccctatcaaatggccaggcgctaaagaactttctaatagaatagacgaaaggtgaagggaaaataagcacaggatagaggagctaaaggaactaaagaagacataaaactaaagaaggaggtgatcgtttatcaaagtaacagcccataagtcctcctagctttgatgcagagcactcattacatttcgtagcacgtagagaaaaaaagaaatccctaaactatctcaggatacacacggctgccatcaatgagggctgacgtcaaaggcaaagtgagctcttgcagttggggagaaacaactgctacaggtggcaggttgactcttctggctgtaacaaaaaaaaggacagtgactgagcccatcttgtgtaggcatatgtcattacccacataaaatcatctactttaaaaaattgattatacatgtcctgtcaagaaggtgtttatcctacaggcctcaactatggagagcactttttaaagtctggagtctctctatgaatttcaggagcttgtctggacatttacacttttgcatgtaagcccaggctcagtgaagatgtacaataataaccaaggggctcatcacagaatgtgagcagtaattacagagcaggagcaagggatgaagggattacagttccagctccttggattgagtggatcttatatctctaactgaaggcaactcccccccccaccccccataaccatatgcaaaagatagagctgtcaggccctcagggtgggctgaagtgggtacaagggaggttcaccttgattgggtcggttgtgccctcagcacaggtgaggggttggtggaggctgaaagccagcccatgttctactcaccaagccagggctgtgcccacccagcccaagaaccacctgtttctaattcacatgaatgcactgaccgatgggcatacattttcccctgacctcttggttgctcagttgaatgtattcaacatgcccctgcttcgaaggtgaagctgaatcacggagagtggaggtagaagttagagtggatggtgtaaatgtcagatagagagggctaaggtagatttgccaccattcgagagcagccagcaataaccttgtcaagcaagtacaaagtgttatgcgaaaggtagaaaaaaaaaccaaaaatataatctttgcgtgttttctctacaatggagcctaatacaaaataggttttgtctctctaggtagataggtagacagatatagagtcatccaggcaccaaaaattgagataaatatgtacaacaggaggtcattctcttacaccggcttaccaggcttaacagtgacattgacaaatccttctccaaaggcgttttcactagaaacagtgactttgaagacataaagtccgacggacaactgtaacataaagaaaagttgtacagttcaacatgcaagacgtgatgggtccactacgtagaaaaagctaaaatgtcccagaagccgcactcctaaagtcagcatagagaaggggctcaggagacagtctcatttggatctgtcaagaggctgccgcatgtttgaagcctgaattctggagcactaaagatcacctagacaggcctttagcttcgctgcagagggcttcaaagaggcctgggtgagatggaccagcagagggcagcagttctcaaatgtgtgtatggaaccatgcatttttaccacctagctctggtgcattggttgccggtggtctggatgccacactttgagaaacacagctccatgacatgagggtgatgcaagtctgtgttgtaccattagctgtgtggtcccaggagatgaagtcaacataatcatctggtaggagactagatctctagtcgctaagtcggtttatatatcctcctaggccagaaagagggcatgtttcttgtgagtgcttgtatcatagaacaatatgtgatagggcaaattgtgacctggaatggaattattggcaactctagagatgtgccggactgagaaccagagataagtagaatgtccttaacactgcaaggagagcaagagttacaacaggtttttaacctctctgcaatgcttgtgggacaaccaggctcttttccccaaactgagatatactaagtaacccaaataaagaaacgccatccaaagcctcttaaccatctgcctgcctacttgcatgcctgaaactttattcattcatatcctacttttgatcttaccatgagaaagatgtttgcagctgggcgtggtggctcatgcctgtaatcccaacactttgggaggccaaggagggcagatcacttgaggtcaggaattcaaaaccagcctggccaacatggcgaaaccccacctctacaaaaaatacaaaaaaattagccgggtgtggtgacgtgcacctgtaatcccagctactcaggaggctgaggcaggagaatcacttgaacccgggaggcagaggttgcagtgagctgtaattgcgctactgcactccagcctgggcaacagagcaagactctgtccccaaaaagaagaaagacgtttgggttcagtagctaagaaggtattaactgagctctatgccgttacgctgtgctgttagacacaaccagtctccagttacttacttgagagaggttaagagtttgcttgtgtccttgttttatttcaccttggtagtctgtggggtggcttattaaattccattcatagttgtaggttgtttctgagagcaaaaaataaatatgagtagttataaattctgagaggacactagataacctgggcagagggaagatgacagcctttaaaccaccagtgcagattaccttagatatactcaactcagctttcttttttttttttaacttatatatatattttttgtttatttgtttttatcccctcactcttgttatcatcttatgaacttgactttcaactatcagccaagataacatgtatcttcttaatgtaacatttctttttttgttataaaaacatacgtcttacaggaaatttttaaaatgtataaagttaaaaaaaaaaaaacctccctaacttaaccattagtatgtgatgagttttttcctagggggctacatctgactatccatatcagttttaacatagtataatacattgtgcttttctctttttaacaaaaggcaaggagatttcaattcatttgatctgttgtaggggtttatttaaggacacaaaaacagtataaacatgtctatgttaagatgaaactgtctcccagctgcagatattagtagttaaaatataaggtacctcacctcaaaggattaaaatgcaaatgccaaatattatcatctctgtgtataaaattttgaccaatatgtggtggagaaaaaaatgaattaaggaactaacctgaatgagaaatagtcaaacaccttaagaatgagtttaccttaaaaacaatgcatttgacaggccacaggtcccaggtcaaatgcttactgaatggtagagcactggacaagtagaagaaagagcattttgaataaatttttttgagcagctagtgtgaggcatcctgagaacctgagagccgtgattgtcaatgccacagtatctgcaaacaaacctatgggtgcacgccacttccctctcatcccggtggaatcttcccaggttctatgggttattacagttcaagaactggtacgtggcagcctctcctgatc

SEQ ID NO: 69 - DNA, 1340 bp, Homo sapiens
gggtacggctgcgagaagacgacagaagggtacggctgcgagaagacgacagaaggggtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaacagtaaacacccttttgaaaccaaaaaaaaaaaaaaaaaa

SEQ ID NO: 70 - DNA, 5096 bp, Homo sapiens
ctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtaaaaa

SEQ ID NO: 71 - DNA, 4868 bp, Homo sapiens
gggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacggggtctgctctgtcacctaggctggagtgcagtggcttaatcatggctcattgcagtctccatctcctgggctcgagtgatcctcctgtctcacctcccgagtagctgagactacagtacaggcgcatgccaccacacctggctaatagaaattttttttttagagattttgctcaggctggtctcaaactcctgagctcaagggatcctcccgccttggcctccctaagtgctgggattgcaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattcatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtccaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtggtcccggcactttgggaggccgaggcgggcagatcacgaggtcaggagatcgagaccatcctggctaacacagtgaaaccccgtctctactaaaagaatacaaaaaattagccgggcgttgtggcgggcgcctgtagtcccagctactcgggaggctgaggcaggggaatggcatgagcctgggaggcggagcttgcagtgagccgagatcccgccactgtactccagcctgggcaacagaacgagactccgtctc

SEQ ID NO: 72 - DNA, 1041 bp, Homo sapiens
  misc_feature (933)..(933): The "n" residue at position 933 is nucleotide c according to the corresponding sequence (GYPC gene) in the Entrez Human Genome Sequence Database.
cccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccaccggaggtgggagaaaatctgggcacgatcgggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtcnttgacatttggggggaacagcaggtgccagagctaaaaggtacctttgtctgccattgatccagctcagaacgattggaaataaatttgaaatgtaaccgagcaaaaa

SEQ ID NO: 73 - DNA, 1440 bp, Homo sapiens
ggaattccgtagctattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctagtcccaagaagatattggtaagctattgaatttagatatgcacctctgataagcaaggattgtttcccgtagattagga

SEQ ID NO: 74 - DNA, 1015 bp, Homo sapiens
  misc_feature (204)..(942): The "n" residues at positions 204, 221, 467, 469, 480, 566 and 942 are g, c, c, g, t, g and c, respectively, according to the corresponding sequence (C20orf16) in the Entrez Human Genome Sequence Database.
cggcacgagcggcacgagctgagattgagccccggggtgtgctaaagaggcagtacaccagtttcttccggccaggcctgcccacagagaaggtggctgccatccaccgcctgggcattggcaccaccgacaagatcttactggaattcgaggagcccttctgggaccctgagtgcaacagcctacagttagtgtgggagaacnaatcagagagccacacnctcacctactcacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttncncggctcctatncatacacacaggtgggctccagcggggcggaaatgtggagaagctggccaagcccctgccgttacacagagagctcaaagacagcncccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctacnctctgtcctgccttgttattgtaagtgccttcaatcttgcattttgggataataaaaaaggctccctcccctg

SEQ ID NO: 75 - DNA, 830 bp, Homo sapiens
gcacgatggaccccaaacagaccaccctcctgtgtcttgtgctctgtctgggccagaggattcaggcacaggaaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagattccggtacagtgacaccctggagctggtagtgacaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacgactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggag

SEQ ID NO: 76 - DNA, 4487 bp, Homo sapiens
ccgcgggaggcggacgagatgcgagcgcggccgcggccccggccgctctgggtgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccaggattgcaggagtccctgccatcatgtttacagaggacagtatttgtggggagggatttcggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcaaagatttgccttattggcagctctactctggaggtttgtttagaagaagtgtgtcacccttaggccagcaccatctctttacctcctaattccacaccctcactgctgtagacatttgctatgacctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttacaacctcatttaactcagtctttaatctgagaggccacagtgcaattttattttatttttctcatgatgaggttttcttaacttaaaagaacatgtatataaacatgcttgcattatatttgtaaatttatgtgtatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgtttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaaggaataagtagctgcaaactatctattcctgtattattgtgttaacattgagataaacc

SEQ ID NO: 77 - DNA, 2416 bp, Homo sapiens
agattatgatcgcctgaggcccctctcctacccagataccgatgttatactgatgtgtttttcctttttttttttttttttttaagtaattaagggtagttaaattatttaaagtatacaaagtccaaacagccaggggtaaggtctccaagaggccttcccagggtaagggagtgcggagaggccccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggacgagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagctcccaaggagaacaaatattcagaatattcatattggaaaaatcacaatttttaatggcagcagaaaacttgtgtgaaattttcttgatttgagttgattgagaagaggacattggagatgccatcctctttctcttttctcgtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaa

SEQ ID NO: 78 - DNA, 1568 bp, Homo sapiens
gaattcgggcgggggagcccaaggagcgagcgcgccagacgaagctcgagccgcctccgccagcgcgaccccacctcggccgccggcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccctgcagccacgggcaccgcggccgccgcctctttagccgccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgccgtcctcctaacgctccttcacaagatggcaaagaggccaaggcaggtgaagcaccaactgagaaccctgctccacccacccagcagagcagtgtgagtaacaccaggctcctcaggcaccttcaccatcggcaggtggacctaaagaattagatgaccattcagaaataaagcaaaaagcaggccacataccttaaccaacaccaaagaaacatccaagcaataaagtggaagactaaccaagatttggacattggaatgtttactgttattctttaagaaacaactacaaaaagaaaatgtcaacaaatttttccagcaagctgagaacctggaattc

SEQ ID NO: 79 - DNA, 2139 bp, Homo sapiens
cctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttgggagtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggtccacgagaacagtctccactggcacggcattgtctcactataggaggagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatcctaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccccaaaaaaaaaaaaaaaaaaaaaaa

SEQ ID NO: 80 - DNA, 1429 bp, Homo sapiens
cagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctacagcagctgcttcggtgatagcaccaagtcgcgcaacaagctggtcttgcccagtctcatctcctctcgcatctatgtggtggacgtgggctctgagcccgggccccaaaagctgcacaaggtcattgagcccaaggacatccatgccaagtgcgaactggcctgtctccacaccagccactgcctggccagcggggaagtgatgatcagctccctgggggacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggctttaaccccgctgatgtggaggctggactgtacgggagccacttatatgtatgggactggcagcgccatgagattgtgcagaccctgtctctaaaagatgggctgatacccttggagatccgcttcctgcacaacccaagtgccacccagggttttgtaggctgtgcctcagctccaaacatccagcgcttctacaaaacgagggaaggtacatggtcagtggagaaggtgatccaggtgccccccaagaaagtgaagggctggctgctgccaggggtgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatggcaagcgcctctacatcaccacgtcgctgtacagtgcctgggaaaagcagttttaccctgatctcatcagggaaggctctgtaatgctgcaggttgatgtagacacagtaaaaggagggctgaagttgaaccccaactgcctggtggacttcgggaaggagccccttggcccagccctggctcacgagcttcgctaccctgggggcgattgtagctctgacatctggatttgaaggctc

SEQ ID NO: 81 - DNA, 556 bp, Homo sapiens
gttgactttttcttttatctttgcaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatt

SEQ ID NO: 82 - DNA, 660 bp, Homo sapiens
atgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataataagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagc

SEQ ID NO: 83 - DNA, 183 bp, Homo sapiens
gaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtg

SEQ ID NO: 84 - DNA, 3120 bp, Homo sapiens
ggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctg

SEQ ID NO: 85 - DNA, 4221 bp, Homo sapiens
ggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaacgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgkgggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgtgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaat

SEQ ID NO: 86 - DNA, 5591 bp, Homo sapiens
ggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacagcgggtcatccggagccgcagccagtccatggatgccatggggctgagcaacaagaagcccaacaccgtgtccaccagccacagcgggagcttcgcgcccaacaaccccgacctggccaaggcggctggaatagtgagtgccctccccctccccaggccccggcccctccctggggggccctcagctctcctctgcctcctgaggcctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatccacccacctacccatctacccatccacccacccacccactcatccatccacccacccatccacccacccatccacccatcaatccatccatccacccacccatccacccatccatccatccatccatccatccatccatccatccatccatccatctctatccatccctctatctccatccatccatccacccacccaccgatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtctttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagaggtgggtgagtgggggacagtgccccattcccctgcacccccatccctgagccccattcggtggcaaagcaaggcaggcagaagggagtgcccgcccctctgcctctccatccccactagtgacagctgtgtggtcaagtccctgctgcgtgtcgggcaccagggccagcacgtcacctaacgtgccacatgcagatcaagaagcggtaggtcagaggagtcaaggggcttgcccagatcacacagccagtgatgggcagagctaggatctgagccctgatctgtctagggccagcatccgtgctcttcccacggccccagcgcatgtgggagggcctagtgctggttttcagggtggccacagatgggcctggggggtccatgagtgtgggcagcatgagggcagtgagcccaggccagcagcagggctgcccccggacatcagaggctagctcccggctgcctccccgatattaaccatgtgtgaccttgggcgagtcactgacctcctctgagccttactgtcccaacctggaaaagggacaagaacacaacccatggcatggggctgctgtggggactcagggcactgcgtgtgaggccagggccaggtcccctgagagggctccaggacgggagtgggcattgtccttgctgctgccagagctccgcatgctgtgagtcctgggttcaggtcttggcactgccacgtcctagctgtgcgtccctgggcaggttccttatccataatgggacagctatacctgctcctgtggagaggacctgggaggagtcccatcctgtcccatatagccccatcagtgccaaccccatcactggccaggctagccagggagcccacaagactgctccagggctggccctgagtataggggcgtgggtatggggcaggaggcaccgtgactcccctcaccgcctgggcctcacgctacgcctgatgccaggcctggtgctgaatccccccgctgcccccgtgtgccccgcagggagagccctccggctggtcagaagaccccagacagcgggcacgtctcacaggagcccaagtcggagaactcatccactcagagctccccagagatgcccacgaccaagaacaggttggggctcagggcacgtggggcttgggggcttgggagtggtgaaccgtccttcccctcccctgcctgggcccgggacagcacaggagccttgactgtgccacagcagggtgtcagggggacctgggcattctctggggccctcctttgacatatacccagcgagcactttgtgcacgcccagccccgcgcccggctctggagcacagaggtgccctgcgcataggtccccgcctcacggccgcaggtccatcagaacgcggcctcataggctgttgccggatcatggtgataggaggaacccgaagcagggttgggggaatgaagaaggactgggggcagaggtgttttagatgggtcctcggggagacacctccatggggtgacatttgaattgggaactgaaccagccctgctaggactggcatggcagaggagctcggccagtgcagaggcctggggcacactccagggacagaaagaagggtggctgggagtggtgacgtatgcctggagtccacctacctgggaggctgaagcaggaggatgattttagcccaggagttggaggctgcagtgagctatgatcatgcctgtgaatagccactgcactctagcctggacatcatagcaagactccattgctc

SEQ ID NO: 87 - DNA, 926 bp, Homo sapiens
gaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactgcgcacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaacccg

SEQ ID NO: 88 - DNA, 1383 bp, Homo sapiens
aaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctgggcctgcacatgaagaggcacctctgagggagcaaagaggtggatcctgtaggctaaaaggcttccaggctgagagccggccgtggaaggagggatgcgtgttccagccaaagcatgccgttctgcacctacccagttgcctccagggcctctccttggaaggtcttttgaaggctaaaaaggtcctgtaagaagtggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgaaaggagtataccatgagatgagatgaccaccaatcatttccttggggggagggggtgtctgcaccttagaaaaaaaaaaaaaaaaaaaaaaaaaaaaa

SEQ ID NO: 89 - DNA, 1449 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 90 - DNA, 6765 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactatgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggagaatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaagctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactagctcagcccaggtggaggcgagatgagctgcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctgaatgtaataaattttattgtataaatatatcaccatttacatgaggggaaacact

SEQ ID NO: 91 - DNA, 3333 bp, Homo sapiens
attcctgcctgggaggttgtggaagaaggaagatggccagagctttgtgtccactgcaagccctctggcttctggagtgggtgctgctgctcttgggagcttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctcggtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtcgctgtcactgacgtcaacggggatgggaggcatgatctgctggtgggcgctccactgtatatggacagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctggacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggcggtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggcacaccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccct

SEQ ID NO: 92 - DNA, 2446 bp, Homo sapiens
gcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 93 - DNA, 1011 bp, Homo sapiens
ggtttattttccagatgcaatcaatgccccagtcacctgctgttataacttcaccaataggaagatctcagtgcagaggctcgcgagctatagaagaatcaccagcagcaagtgtcccaaacaagctgtgatgtgagttcagcacaccaaccttccctggcctgaagttcttccttgtggagcaagggacaagcctcataaacctagagtcagagagtgcactatttaacttaatgtacaaaggttcccaatgggaaaactgaggcaccaagggaaaaagtgaaccccaacatcactctccacctgggtgcctattcagaacacccaatttctttagcttgaagtcaggatggctccacctggacacctataggagcagtttgccctgggttccctccttccacctgcgttcctcctctagctcccatggcagccctttggtgcagaatgggctgcacttctagaccaaaactgcaaaggaacttcatctaactctgtcctccctccccacagcttacagaccattgtggcaaggagatctgtgctgaccccaagcagaagtgggttcaggattccatggaccacctggacaagcaaacccaaactccgaagacttgaacactcactccacaacccaagaatctgcagctaacttatttttccctagctttccccagacaccttgtttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaaaaaaaaa

SEQ ID NO: 94 - DNA, 568 bp, Homo sapiens
tttttttttttttttttttttttttttttttttttttttttttttgaggggcctgaaggcttttatttgactggtccatagggtggggggtgcacccctacagggccaccttggggtccacttccccgggtccctggcctttgcgaactctgccgccttcttctcccgccgcttcttccgctggagcagcctccgctcccgctcaaactccttcatgcgcatcacatagtcgcggtgctcgcagtagtcccagtcgtgccgctcctgcttgcaggccaggaagttggggaagctgtcacgcttgcacttgagcagccggatgaggtggtgggcgcagtagtcccgcagctggagcctcagctgcgcgtccatcatctcctgctgtgtggccaccatctcgggctccttgcgttcggggaagccgtagtctggcgggaaggttggcatctgcagggggtcgggctcaccgaggcatcgccaggtaacgccgaccaggtgccccccatggttcagtcgtgaaatccctgaaagccggggtcaccaattctaccggaacctcggccgattt

SEQ ID NO: 95 - DNA, 1085 bp, Homo sapiens
ggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaatggggatgcttgcatgtgtaatcttactaagagctaatagaaaggctaggaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacaaaaaaaaaaaaaaaaaa

SEQ ID NO: 96 - DNA, 618 bp, Homo sapiens
ccgccagttccttcctgctccctgaaatgaccagtgcctccctgaggacaggcacatcaggtctcagccaaccttcccttccaaacataactcagctagaccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatg

SEQ ID NO: 97 - DNA, 2727 bp, Homo sapiens
cacgagaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctcagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagtgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgccagcgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctcccccgctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacgaggctgggggcctcctgctctcgtccctggccctccctgtacagggcaaagccagtctgggctctggcacacagagttcatgtttgccgccctctccctgcccctcaccccagaggtgagaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggccccagctcagcctccgcgagggaggtcacccctccacttcagcttgccctgacctccgctcgcaaaccccgagcttccaagccttttgctccagccctgcggcttccccagaagcctgggcttagggtggagatgccgcctacccgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacacctacacccacgcaccccctcacacactatgctctctcaagaatgtaatttattggggcccccccagctgctttcctcacctgcccctgccctaccttacacccccagcttgacttctttccagtccacgtggatataatgatatctatatttttgcccaggtctgggtattgctcctgcccagaccctgacatccctttccactgtgtgtgtgaccatgctgggggagggggactctgcttggaattaaaaggttgctttgggtcccta

SEQ ID NO: 98 - DNA, 927 bp, Homo sapiens
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttccaaaa

SEQ ID NO: 99 - DNA, 1808 bp, Homo sapiens
ccgaccttaccccaggcggccttgacgttggtcttgtcggcaggagacagcaccatggtgggttctctctgagtctgggaattcccgagcccgagccgcagccgccgcctggggggcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgaccataagaaatttactgtgaaaaagcgttttaaaaagaaaagggtttagaatatgatctattttatgcatattgtttataaagacacatttacaatttacttttaatattaaaaattaccatattatgaaattgc

SEQ ID NO: 100 - DNA, 510 bp, Homo sapiens
tttttttttttttttttttttttggatattcaaatacatttattcaacaataaggccagtcaggcctcgcggtgacctgatgggatttcaaaaccttggttctcagcaaggcccaaatttttgaatgaggatagaagtctggcgtttccgattttcaaaacataacacgcattcattgggataagtatttccatcagtcccacagacagggtcatatattttggggcatccattaagttcattggaacatttggcctctcttcccagggagtcagctccagtgttacctaaaaataaatcagatatggtaagttgggtcctaaatgaaagaagtcagatctattcttcatcagaattctctgctttcattgcagactgggacttctttactaggctctttcattccccaccctttctgatttctctaatcttccaaaagtatctgactgattttcctgtaccccttccttggcaaaaccttaaaaagtttgagtaaaactttgattatga

SEQ ID NO: 101 - DNA, 1097 bp, Homo sapiens
agagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaaaaaaaaaaaaaaaaaaaaaaaaaa

SEQ ID NO: 102 - DNA, 1374 bp, Homo sapiens
attgcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccattttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcactgagtggacggattcaccaat

SEQ ID NO: 103 - DNA, 540 bp, Homo sapiens
aagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggggatggggtcttgctttgttgcccaggctagagcgtagtgacacaatcatagctcagtgcagcctcgaattcctggactcaagggatcctcctgcctcggcctcctgagtaactaggactacaggcaggtagctgggactacatacgtgtaccagcacacccagctattttttaaaaaaac

SEQ ID NO: 104 - DNA, 3632 bp, Homo sapiens
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 105 - DNA, 2075 bp, Homo sapiens
gagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaca

SEQ ID NO: 106 - DNA, 2056 bp, Homo sapiens
gtggaaacctcttcagcatttgcttggaatcagtaagctaaaaacaaaatcaaccgggaccccagcttttcagaactgcagggaaacagccatcatgagtgaggtcaccaagaattccctggagaaaatcctcccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatccgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactcggaattcctgcagcccgggggatccactattctagagcgccgcaacggccgtggagtccagagatg

SEQ ID NO: 107 - DNA, 433 bp, Homo sapiens
atggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcgctcaccatctggaagaagatgggctgag

SEQ ID NO: 108 - DNA, 1638 bp, Homo sapiens
gccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaaaaa

SEQ ID NO: 109 - DNA, 1966 bp, Homo sapiens
cctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgactgcttatctgctgtacagatcccaaaactccattatgaagtacatcgtaattacccatctggattgcagtaatggcagtgaaggaatatgatcttggtatagctcattaattctgattttttgctttgaggaaaagagatacgtggcagcaacagctctaagttgactgcttttaatttaaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatattgttccatagcacgttatccctggcttttgttaccagtaaaatgaatgactttgctgagacatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttacatttattttctgttccgcattcacttaacatgtgcgtaaaagggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaagaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaaccccttgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatcctcagtaaagccaaaaagaaataaatatattgcttttcaccctctggcgtggagggccctgaacagagccctctaaagaacagcttgtcctaatcatcatgtacctgatgaacctctgcttcccctgcagccagcgactctgcggacgatggctggtctccatggtccgagtggacctcctgttctacgagctgtggcaatggaattcagcagcgcgggcgctcctgcgatagcctcaacaaccgatgtgagggctcctcggtccagacacggacc

SEQ ID NO: 110 - DNA, 3312 bp, Homo sapiens
aaaaaaaatatatttaataaaaaagttcaaaaaaggggggggattgtcatctccttttggggtgcgatggctttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggttcgtggaaaaaaaagcaatggctgagctaagggatggggtaccaggttagggggaggaaacggtagagagaaataggtggggctcccgcgcatgctcaatagggaaggggcgcccgtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgaccgcagtacacatgatcaggaaggtccctgaactctccagtgtcttcctcccaccctgtgcccaactgcttcatgagcgtcaccatggcatcctgctgggcaccatcacgctgatcacggagctctgcgggcgaaaccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtggccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgatctacggtgtgactgtgactcaggcatcctgctggctgcagagaggtttgctccaaccacacgctggcacatagacaccatcctgcatgtgctgacatcggcgggcacccatgtgcgggatgatgcagcgggccacaccctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatcttgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagcaaaaaaa

SEQ ID NO: 111 - DNA, 3858 bp, Homo sapiens
agtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgattttggtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaattttgggcaggaccattattgatcaagcaaataaattcaacagccatttgggaaaaag

SEQ ID NO: 112 - DNA, 1660 bp, Homo sapiens
cgggcgcgagccgccgcagccccgcgcccgctgctctctgcggagccgttttgtgccgcggcgcgggggaacggggacgcggggcggggggcgcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggacttcacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggactctggcaatatcataaatattagtaaaaatagcatgttcccaatgatgacttacagcactatgccttttaaaaataaagttaaaagcaactacaatgactgtactctctaggaaaatttacaggtgcaataaaactacataaaaaagcaaaaaaaaaaaaaaaaaaaaaaaaaaa

SEQ ID NO: 113 - DNA, 1227 bp, Homo sapiens
caggcctcctggcagcacctgcgcagtgaacaggctggctgaggtgcacgggagcccgcccgcctctctctgcccgtgtcagtccgtgaaattccggccggggctccctgagatggccctcctgacagctttggacgacaccctccccgaggaagcccagggaccgggaaggcgaatgatactcctttcgaccccgagtcaaagtgatgccctgcgagcctgctttgagcggaacctgtacccgggcattgccaccaaagaagagctggcccagggcatcgacattccggagcccagggtccagatttggtttcagaatgagagatcatgccagttgaggcagcaccggcggcaatctcggccctggcccgggagacgtgacccgcaaaaaggcagacgaaagcggactgccatcaccggatcccaaaccgccctgctcctccgagcctttgagaaggatcgctttccaggcattgctgccagggaagagctggccagagagacgggcctcccggagtccaggattcagatctggtttcagaatcgaagagccaggcaccggggacagtctggcagggcgcccacgcaggcaagcatccggtgcaatgcagccccaattgggtgacaccctgctctctcgtgggtcgcctttgcccacactggcgcatggggaaaggggcttcctgcaccacacatgctctcccacagtgggctttcgtgagccatggattgagggccgtccctgtgctcctgcccagccaggccgcgcaggcagaagggatctcccaacctgccccagcacatggggattttgcctacaccgcccaggctcctccagaaggggcgctctcccacactcacactcctaggtggcatccacacaagggcaaaatccggaaggactgggacgcgcagcgcgacggccttccgggcacttgcgcggtgggacagcctgggccctctcaagcggggccacagggccaaggtgtgcttgcgccacccgcgtcccagggaagtccgtggtgggggtggagcaggggtacccaggtcgccggtgtggcgtggaacctcaagcaggggcaattccacctcaccagcccacgcccccagaggcctccacacggcaggggcagatgcaaggcatctcagcaccctcccaggcgctcctggagccagggtgctcgtctgcactccactccatcctgctgctggatgagctcctggcga

SEQ ID NO: 114 - DNA, 33023 bp, Homo sapiens
cttgcctcagcctccccatagctgggagcacaggtgcgtgtcaccgccccagctaatttttaaattttttgtagagacaaggtttcgctatgttgcccaggctggtctcgaacccctgggatcaagtgatctgtgtcaggcctctgagcccaagctaagccatcatatcccctgtgacctgcacatatacatccagatggcctgaagcaactgaagatccacaaaagaagtgaaaatagccttaactgatgacattccaccattgtgatttgtttctgccccaccctaactgatgtactttgtaatctcccccacccttaagaaagttctttgtaatctccctcacccttgagaaggttctttgtaatttgtaattctccccacccttgagaatgtactttgtgagatccacctcctgcccacaaaacattgctcctaactccagcgcctatcccaaaacctataagaactaatgataatcccatcaccctttgctgactctcttttcggactcagcctgcctgcacccaggtaaaataaacagccttgttgctcacacagagcctgtttggtagtctcttcacatggacgtgtgagacaatctgcccacctggtcctcccaaagtgctgggattacaggtgtgagtcaccaggcccagccgagaaagagttgaatacacgtagaggagactggagttttattattactcaaatcagctgccctgaaaatttgaaggctgggatttatttatttattttttatttttttgagatggagtctcgctctgtcgcccaggctggagtgcagtggcatgagctaggctcactgcaagctccgcctcccaggttcaagcgattctcctgcctcagcctcctgagtagctgggattacaggcccgtgccaccacacctggttaattttttgtatttttagtagagacggggcttcaccatgttagcctggatggtcttgatctcctgacctcgtgatccacccatgttggcctcccaaagtgttgagattacaggcatgagccaccgtgcccagccctgaaggctaggttttttttttgagacagagtctcactctgttgcccaggctggagtgcagtggcacaatcttggctcactgcaacctccacctcccgggttcaagcgatttccggctaacttttgtatttttagtagagacaggggtttcaccatgttggccaggctgctcttgaactcctgacctcaagtgacccacccgcctgggcctcccaaagtgctaggattacaggtgtgagccaccgcacccagcccgaaagctaggattttttaaagatagtttggcggacagggggctagggaatgggtgctgctgactggttgggtgggggatgattcttgtgtgctgagctgagtctgcttttaggtagggccacaggaccttgagtcataggtctatgtggtccgggtggagccatctggtagtgagaaatgcaaaaacctgcaaagacgtctcaaaaagccaaccttaggttctacaatagtgacattatctacaggagtaattggagaagttacaaatctcttgagctctgaacaatggctggtcatcatgaatgcttccatgttagcagaattcaggcccctctcatcctcctcacctgatggcctttcattacttttacaaaggcggtttcatcttgggaaggtctgttatcatttaaactataaacgaaatttctcccaaagttagcttggcccatgcccaggaaagaccaaaaacagtttggagggtaaatgcagacagggttggttagatcagctctctcactggcagaattttgttactgttacagtttttgcaaggcagctttagggtgatgggtctgcacggaatatatgcatgtaacagaaccgcgcttgtaccctctcaatctataaaacaaataaaaccagcctaataaaagtttacataaaatgtaaaaaacaaagcaaagcctcctttctgcgggtctgtgtaaacgagcacagctggtgggaagggcgcgggtggggggttctgctgccccccatccctgccctgctgcaggccctcgcccccagccccattctttctgttctccgcttggctgcagccgcacgtcggccccctccccaggagctggaagtacaaagcccttccaggtggactctggctccccctttgttcccagcttattctaattccaaagctcattgtgcccggctcgccttcagaagaggaggcgcccccatcctgtctccagctgcccatcctcccaggataaccagtcaccccagggcccggtggcccctcacccagcccctccccggtccgcagctgccctaggcttgagtgggcgctggctccaattctcaggcctcccccaacaaacaggagcattccggctagcccccctcccctgccctccccccagctccccttctcctcccctctccctcctcctcagctcctactccaaccccccagccccagctggggcctgaaaggctgcccactccctgggacacggtaaggggagggtgcagctctccccccgcccctccccggtcgcctctgccccagagaacagtttgcttctcacccagaagccaccataggagctctgggctgggcacaggtcgcagggcacccccaccccctcctgcacatgctcggaaccccccttcagtgagtagaacacaagggcctggcaagacaggcggaggcttggaaagggctggcgggggacagctacccggccctcagctgggggcctggagagcccaccctgcccctccccagcagctgctgcccccgggccgagcctgacgcgccttgacaaagcccgagaacgctttgaagccttcggacgtgggagaggacccagccagggatggaaatcgctttgcctttgttcccccaactgctcagcagctcgtgggagcagcctcagaagaccctgtcactggccgcccgggtcagagcctgtgacagagaccagagctccggccggagctccccgccggaaactccagccttaccagcctgaacttcatgcactgctcaaagaggcccagctcgccctggctgggcaggggcggctcccagggtggccgacgtggggagggttcctgaacctccctcaggagcctcctgggacagagtcctggaggtcagcagagaaagggaagcccaggctgtgggccccgcgtggagggaaaactcagggggaacgccccgaggctgggagggcacagccccatcacactccatctcgtagtcttggagaaaaatttagttctacctccagggcacagaaaagcccaaagaagggatgagataaaggaggggctggtcagatttgtgcttcaggagggtccctctggctgctcagagaatgcagtttggggtctggcccaggccgtgaggaggagttcacagtcactatggggtccagaccagctgggggcgggaggcagggcctggcccaggggctggtagtgggtgcaccccaggctgggctggcaaagggcggggaagaaggtgggtgtgggaaggggtggctgcctggagaagagcccagttccaggaggtcgtgggagtcaggtatgggggcccactggacctcccctcagatgtgggggctcccactccgagggtccatggagcagtggcagccattctggacagccccccacccttcacttctgtctccagtaccctccagcctggccacctcgccctctgcctcggcctcctctgatctcacaaaggcagcagcagtcaggggtggcgactccctcatgatcctgtccctggcctcggaacccaccggaggagtaaccgcagcagtggtcacttccccaaagtgccatcagctctcctacatccttctcgagcctctgctttctctcccttccacccccacccctttgacaagcaacatctgaaagtctcccctgcccgcggctcccagagctgtctggccgtggcctgcactctccctcaaagcggccctcccccaggtcaccgtcctcccttcgatgacatcacgcgcccaccccgcactcctgctgggctgaggccctccgagcctacttcaccgggtcctcttctttctctcaaaggcaatggggtttgcctgtggtccagctgggttggccctcttccctctgtcctgggtccttgagtggccccgcttctttaggccatctatgagtcacttctctaatgcccctgtctccagaccagcttcagtcaaaggctgggccagagaagaccctagtgagaaacttctgatgagcagtgtgaccttgccacctcaggggtacccacccaccacccctggtctaagcacaggtgacaccgcctgtctcccccaaccacacacaccccttgaggctcctcctccaagcctgggtggggacactgtccctccctcacccagcaagctcaatctggcttgggccggaactgcttttcttcctaaagctggacggatggccgcgggcttagcttaacgggatgagccatctggggactgcagtgtccacgatcagatcagggagcttgaagctgaggggggcacactttacctcccaggccaggacaatgaccacttccttccccaccccacccccaggctactcttagccctagaaaattctaaacaagctgctcagctggcggcggagaggcagcccaacaagctggctcttgctagggaggcctggggggtcctggggagaggaacacggggtgggtggggggcgggcagccaggacctcaggcctgaggcctttggggaagggtctgtgcacctgccaggcaccagggggcagccttgccttgttcccgctccagtcccctcaagtccgaagcccctacccactctcacgccaggcaggggtgggggccgccggggtcatttacccgggccccttctctgccttgatgacaaagtcgagccttgctcatcagccaggcaggctcccctctgcccactgtggagacacagaggcctgtcacctgaagagctggtcccggcctccagcttccagggtagccgggaagctgtagcccccagtgggcagcggtggagagagctcaaggaaggagggagcaccgggaggagacggctgcagcctgccaggagcggggagaaagggagagaaggggaggcggagggctgagggggcccgggggacgtcttcccagggctgggaggggccggccgggaagcctgggctgcactaggagccggcgaccctggggcgaggggcggcccggagccctgcgggaggagctggcggccgccccaggtagcaaccatcctgcctcccgctggagcggcgtctcctccccgggaggagggcagggaggaggtgggcggagtgtgacgaggagggcgggagggagggatgcgggagggggagggggaggggggccggccggccgtgggggtggggcgatagtgacatcaccccggagtcggtttttaagcggcggccggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgtcgtttgcagaccgcgggcgccgatgtcgcccgcgccccgttaggatgagtctcgggtcgggcgaggagccgccgcagccgccgccgcccgagccgcgggcaggagcctcgggagccgccgccgccgccgccgccgcccggccgggccccgacgccgcccgcgcgcccccgggcccccgacacacatgagattcttcaggctcactttcaagtgcttcgtggactgcttctgactgcgccgcccgcgccccgcaccccgccgtccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccggggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaacccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtagggccctacccccagccccgcctccagagcagcgagtgctacccagatgcatgatgtacaggaacatgcaatagaaatgctgaaaagtgacgaggattcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcggggaagggtgggcgtaaagccatgggtgctgaaattttcaaaatgttaccccaagaatttgtcactgaacaggtgccttgtgtcacttgggccaggctggtagcagcagaggggataactctgcatcagggatcaattttgaaggtggagccaataggggttgtgcatgaccaggatgcagggctcaaagaggagttaaggacaacagatttggcctgagcaagaggaaagatggagctgccaggtcctgcaatggggaggcaaggagagaatggtctggagtcagccttgggtgtgtcatgcaggaagtgtcatccaagtggagatgtctagttggcaggtggacacaggagttccagaaagtactggagatggaactgtgcaagttcttaccacatagagatgacactgaaagccctgagcctgagtgagctcacagggacgccgcaagccccggaacacaatgagaggggcagagcgaagacgtggcagtgataggggaggacgcctgagagttcctggtggggtcctgcaacctgagccagtgaggacccctcacaggtcagggaggagcagtggctggctccatctgtccagtgctgctgctggtgaaggacagtgacctgcaaatgctcactgagtctggcaagggtcacgggggcctggcgagggtggcttgcatgagcgggtgcgtgtgaaaggctgggtggtgtgcgactgagaaaaggagtggcggcagcgcagtgtcatctgcagacgaagggagagacaacaacgtagttcacccagacaaggaaatatgagccagcctggaaagggaaggcattccaacacacgacacaacatggctgaccctggagggcatttctgtgaaatgagccatcataaagggatacttgctatagggttctgctcctgtgagagagacagggccttacatgagaggagggagatccacagagacagagggcaagggtgggtgccaggggctggggacagggtggggagtgttgagtggggacagagtgtcagtttgagaaaataaattctagaggtggatggaagtggtggctgcgcaacactgtgactgcacttaatgccactgaattgcacatttaacgatggtgaaaatggctcattacatatacactgatgacactatatatatgtatgatatatatgcgttttaccatgagaagaggtggagaggaattggagacactgagtacagacaggtccttcaacgggcgggaccccgtgcacaagatgagcatgtggcaccccaccctcaaagggctgggcaccatggcagggcacagcaggcaatgcagtgggcggctcaggcaagcacagagagcatcagagattggagcctgtgaagggggagcaggtgacccctcagagcaaagtgacagcttgggctgctccctttgcgtcctgcccaggactgctatcgtgctatgggagaacccccagaggccctgctcctcagcaggcagcaccccctatggaggggctttacccctaaacttctggagccaggggagggacctggcttggaatacggccaaccaagagcctgggtgagaaatacacggaccagacagggagcagagaaaggagtggcagtgcagtcccaccctagctcagccaggggctctggagcctgtcctgcagtccctggcccccatctcttcagcaaccgctgtttccagttttctttttctccctgagaagcctgtcctctcaccatgcctgcgccttcaagaaccccgcctgctggcagctcccacatctccggcctggccctccttagctgcaaaggtgcttcccaacatcagcaagacctctccccagggtgccccaggccctcacacagcccctgtccccaaccgactccaactgtcctgcagcccacagtcaccctcaggacccctgagctcaggccaactgctttatacactgtcagccaagtctctgcctggatgacaatcaccctctgctaattgttctccgcacctccaggccaaatgccctccaagccacctcatgcaccacgatgacactaaacacacagaaaaaagacattgaaaaaaggaaacttcacagaggcctgtcacttaaagagggtcctgaaatagagacaccatttcctcaggacttagctcctgcatcaggggttaggacacagagatcaacaagcagcaggctttgccctcaagcagctcgcagtctagtggaagatgggtaagaaaacagatcaggacgcccacgggtgcagatgccctggaacagaagctgatccaggaaggcgcgagctgcaggccgccctccagtctaggctgggcaagcacctcaattttcatctctaagagcctgtgcccacaccccctgccccgttgttgttccatcactccactagaaagggcgctccagaagctggcctcgtgcagctttctgtctgctgctggcctaggcagaacagcggaagaagccatcagggctggtgagggaagcacccgtttggactttagcctttcaaagctcagagaagggtgagctcagggaggtccaaggtagctgagagcacttcctggaaaagtgggatcagccttcggccttggcacagcaaccagagggtatcgcccacgtgtcccctactccctcagacaccacctctcagaccgcctggaaagggacagaactcgtcatgaggcggctgtgctctgagcacaagggaagggcgacaggatgctagagaagggaaccactggcctgggcccggacagggcaggcagaagcgagcatgcacagcaggccgtcagctaccctgccagcatcaacatccttcaggggtccccccagttccaggagacacacctctaacctgctcccctgacccttccgcccagtcctcatgcagacaccaggcatggcagaggccctgcagggtggaagcactgtgctgcgggcgggggctgccttcctcatgtgctactggagagtagcacagtgcaggggcctgggcactggtgccaggcaggaagccccggtactggcctggcttgctgtgggcctggaagacacagctctgagggagccacgggagggacaccctggagccagcacagcgctctggtggcaggcacacacccagcacgttctcagggccaagggccccagcccattcccagcccctttctgcctagctctgccctgggccagctccaggtcactgccaaggacaagtctcctctcccagctggcattagtcagaggtcatcctgcaaaccttcgggggggggggcagggagtgactagtggcgttctgccacgttctgtctgtcccaaatgtgacgaacaggaacccagagaaggcaagcgagtcctctacccggaagccccgccggtttactgagcctcccaagctgcccacacccagggaggcagacaggacacacactcggcgggtggccctgaagcgaggcctggcccagcccggggagcaggaggacagagagggcaaggccttcgagaacaggtgtgagcctggccttcagtgggggaaacaggttgaagggctgtggccgcttgggggctccaggcaggagagaaagcagagccctccccacagctgcagtcacacaccgcaccacgtacacaccatgacaacttttattgccctcaagagaaactccagtccacctgctccacccaccctcctgcgggaccaaagaaaacacccagagggcaaaacaaaaaggggctcaaaccaacaggaagtcagccccaccgcaagccggactacaactaactcgtgctctccacgctcaggcgtggaagccaaggctgtgccaggcctggccaggccaagcaggatgacagcaaacgcattctgaacgtgtagcaatcaggtcccctgtaatgtgcttggagagtgtggacaagggccgagatgacgagctatgagctgtggaagggaatgggggaagcagaagggcacaaacagaagtactggagggagaggccaggctctcaggaagcagcaggcacgtgccaggtggaagccagctgcaggcaggggaggaaggaggcccttactcttccttcttgtccatgggaccatctactgcagcctggaaagggacagaaatcccacagcagtaggttggccgggtccactcctcccctgccacctccagccccatgccccagaggtccacctcggttcccctctctcctaacaacagctattcaagtgaacaaggggccccctccccagctgcacccaaaggcctgccagggtgggagcgtcagccctggcccacgctctagggaaagccctggacctaacgccagccagggaggactgccaggacctcactgggggctgagtcctggctgcagggaacagcaaggcatccagtccccttcaagacctgatcagacccttcccaactctgcacacctttgaacaggtgccctcgaagcccatctgccaagcctgccccatacagagggcatgggtgccccctttgaggctggacccttcctccccacctgctgtggtgcccaaacttgggccaccaagcactgaggccagctgtccaaagttaggagtatttatgtggccctcactcccaacgtcaagaccgcctgggcttccagatgcggcctggtgcacccaagctagtctgaggactcagatcaggcctagggcagcaggtgatggccacaactagcgcctgctagggaaggtgcctttttgacaccttgtgccctcacttgcccagggatctttgccctacgtcactccccagcaccctaggaaagaaggccagcagtgggtcccagagtttcacctgcttctttgttcttgaccaggccccaaaccatggctgcgcctgagcacgaaggtaggaaggctcagagcctagtgagccagtgccactcctgagggccgccttggcaagtgcctacatctgctgccaggccacccccctcctgcccggtgaagggtcccactcagtagggcagaggtggccagggggagtggtggagagggcagccagcccctgggcccctggaaggttccctccgcacccgcaggggctgcctcatcctgctctgctctcctgccctgggcgcagcaatacgggagggctgacctgcagctttgcgtgctcctccagcaagcggtcgtactccttggtgaggccctcagactgcttccgcatggccagaacctggttttcagctttctctagttcttgaaatgatgtaaatgaccaagaaaacagaaacgaaaagacaggaattagggggaaaaaacccgactgctacagacaccagaaactggcccaaatctatctcaaacgaggttatacaggaggctacttctcaaaataaagcccctctgcttttgcaggcccccaaagtagagggaaagggctgacaaaaaagctcaagataaagcaaaagaaacacagaggccatcccccagtccctttaatggagaggaactctagtggctctcggcaagggtaacctccagggaggctgagagtgggagacagggagcaagatcccagcctgcaagcgagacccaatgacaaccacgccttgcacacagcagcagcaggcgaggcctgtggtattgggggaaaacgccccagacttaagtctatgcgtgggagaccaaagacaggcaggccgcttgggagccgcccactcccctcctgaacgccactcccacactcccctcattctcagcccccaggcatgctggggctaccgtgccacactctggacgggaaagccccagcatgcactgctctagtgcagggcaatcgaggcccaccaactgcagcctggttcctcctgagccccattcaaaccacttagcctcactggcctgccggctaagcatggctgcattggggttggaggcgcagggtgctattggtctgttttcagccagccctcgagcgtgcgtgcaaggcttgttactaatactttggcacaaaatgggcagcagcgggcagaggaggctcctctggacttccctgcggggaaggacacgaggtcgagcctcactttgcttagtgctggccagctcgtcctttagcttctgcaggtcagccttcaggctcctgttctcttcctccaacttcacctcagcattcccgacatccaacttgcctccgtcaacagcagctccctgggaaaagtgccaaaggccagggttactcaggagggagggagggagaggttccagccccatcctccccaccgagctgcggttcctcaagctgccctggccacacgccccttcggaaatgtcaacgcggaaccgagccaccacttgctcccagctcctaggcaaaggccagggcgtggctgcccgccgagggaaagagaagcgccagcggggccacctgctgcagctcgccgggcacgccttgcctgccctggcccctggcccctggcccctggccctgcctccttcccaagcagcagggctcagcagctccatggtgctcaccaacccctccacagatggcggtgcctcgtgctccctacatggtgccgctcactgcagttaggagcccccagtcggcctggccagctctatcccacctctgcatccacatccctccgagcttgccttgcagctcacctcctgacgggacgtctaagactggccaactaccctgcccccacctcctctccagcactgagggatgccacagaccccgagttccagagggggtgcggcaatcttgcagggaacaagggcctagctgagggccttcggatcacagcagagggcctggctcactgaggggccatttttctcagggaagggtctaactggaagcagtggatggaaacgagagcagcaacaccctcctcctcacccggaccctcacacacagacgcctccagcaggcatactctccccactgaggacttcccctctgcgcctccacccaactctggcttttcaggcacatttcccagcgtgacaggctagcagtggccactgaggccctgaagaatgtggctcccacagtgtaacaccaggacgccccatggtgggtcgggaagctgggctcaccttcttgagctggtcattctcctccatgtacttcttggccgcctcactagcactctccgcctgctttttaaaggcttcattggaggccagcagcgtggcctgctgcgaaatgagagtcaccaggcgtctaagcaggctgcaattatttacaaaaagaagggagaagtgagaaaaagagcatgaagggctggcaggagcacctcctggttgctcccactccacacctagctccagcctggacctgccctcttgccaaggcagccgagtgagaagccgccaacctggtgctggcagcgtgagggaaaaggtggggcccaggagccgtcctctgccgctgtgcccaacggccaccctcagctctcagaggggctggaagcaggagcctggggggctgggaagagcctcgctacagcatgaggtcccagaacgcggcactttccgggtcggggcctagacgtgccagacaagccacagcaccaccttcctccctgcgaggctgggcttgccttggtaaggtaacgagagaagctaatcaatccaagcacttccaacatgccaggccgcatcctcacatctacctgatgaggaagttactatcactgccccagcttatagaagaggaaactgaagttcagcagcgtaaatcaatgtacccaaggccaaaaaccagaaatggacatggctggaattccaaattatgtctgcctgactccagaacctgagctcggaaccactctgctctctaaactaacagggaacagctcccaggtcccaacgtaagatagaactctcttctctggccagcctccttcccaacccatcatgcaggctgcgctggaacacatccgttatgtaacagcaccccgaatgaggtcttcttgggctggagggtgtagaggaatcaggacacaggcgcaggctgcctctctgaagcagccaggagagacaggcaaacaggtggcagctggaggcagatgctagtccccaaacagagattggaatggccacttcatttcccttggttcacccttgccccgagatgttagctggcaggaagagaggagggaaggactcgttcaaacagtcaaaacaaggcaggggttcctttctcacacacctcagaaggcaagggtcacacagggcctgggggaaggaagagacaaatctgcttagtccagagtgcttcaacaacagcttactcagaagagtcgaagtggcctcctgccccagccaggccttcacacttcacagcctctgctcatggccaggggcagcccggaagggctggagaaagtaaagagcagacaaggtgagctacctccctggcccaagccatggctctccagggcctcggcagagcccctttccagatgtactcaggacagaaagtacccacccgggccaggagacacccctgaggttcctggtttggggagaggctcccaggggcccctggcagcaccaggagagccaggccgttgattcctggcagagaaggagagtttccagtgacatgtgctttctaaaattagcggcccaggacctcgtggcctagggctcaggtttccctgcctcagcccccagctgcccaccagcctgccccgcactgggctacagcctgaaggtggaggaagctactgagcgccctaggagccagagagaaacaatgcatctgactcacatcggcatggccagaagtcaatggagaggcctagaaagaaaggcaagtctgactaagacccaggcccccggcaaggagctgcccagccccagagcggatcccagtgatgtagaaagaggaagaggaccgctcctcccagctggaattgaggggtgggggtcatgccacctggtggtagagagaggaccaagcaagactgaaggctatactccccgccaccaggccaggcaagcggctgctggtgagtgcccatggctgtcaccccagtacccagggagatagctaacacaaatgcttccgcggcagtgcagcagaggcccagctcttttcggaccgtcccaggcccttcccggctattgagaaccagggcttccaagataggccagggcatacacaaagtccagcgcaagatccacgctgtgtgtgtccgaaagcctggccctgctcagccccagcccaggccttcagttcccagccttgagacagtctggggctcccctctgccaggccccggttccccttcctcttgccaaccctcacaggcgctccccacccccacagcaccccgggcatactcctcccactgcacccccagcccgatagttctttttcacaccttctaggtcctctctcttcctgctggatgacccgggatcattctccccccaggaacctcaccttcaactgcctccttcctggagtcaccctgcccaagcccctggtcttttccctcccatatattcctcaacctaggctggccaaggcctgcccttccaagccagcagcagggccaccagtggcctcctaaccgcccaggccggaggtcaccctgaactccttgctctgctgctaagttaccctcctgaggtcccctcgcaacaccctcctcccactgttattctgctccctctggggtctgcactcttcagctgacaccctataccttcctcccagccactcttatccccgaaagggttttctctgtggcccagactcatacctaacctcctgctaaacattggctcctggatgtccccagagacattctagactcagcttgtccaaaacgggccttcccttgtcctgcctgacctgaccacctcgtgtagcccctgctgtagtggtgggcaggcaaaccgccttggactcagccctcttggcccccagcccaagccacaacccagcactttccatgtcaactgcaaacatgcccaccatcatccccactgctggcgcctcctccctatctgctgccatacggctttcccatccacctcccagagcaaggcaaatccgaccatgtcagccctctgcttaagccacctgctgccagcacgcatgccctcagtgagctctcctccttcactaaccacgtggccccctgctctagtaacacctaacccctcaccattcctggaacacgcctggctctgtgtggcagttctccaggccggaatgtcctctcgacccagctcaatcctcacctccccccagaaacccttttggatctcccaccccatcagagggacgccttctgggggctcctgcagcagccccccaggcacccgcatgtaactacctcattctctgttctctgcgtggctgccatccgtttatatggctgccctaccaggctatgaaggtctttaggctgggcactgtgccttcatctctgcactcccatacctggcacactgaaaaggggtcttccgcccactccagcaagtatagctaaaaaaaaaaagggggggagggcgcggggctgggcttccagatgactggatcccactcccaggagaggaaatgctccctgacaggtgaggggacagatttgaggctgcacgtaaggctggacagaatctccctgggcctagactgcacctgtgttcacctgggagcctggcaccaagaggggcagaggcagacacagagctgctcagtctagcaacagaggagacagaagacaggagtgggaaggcgccgtctcagacccgttctgatgggcaagccaggctcatggctgcagggggaaaaaacattcactgccgcgacctgaaggcacaacccagagctccagcctctgcatcctcacaccctcaacccccacccagggcccaagcaatgcagaccaggtcctctctgatcactggcatttttcagcctgggagccagccttctagaacattttcccgctccctcacactgggtcactcaggcacgttaacgtgcgcttgtctgttcccttgtagcttcccaggcccccaggacagggcacgaacatggcctttagcttctgcctctgctggatctcccaagtagtcttacccgaatcactgttcttagctattcatttccagaaaacaggaaagaacctaagagccaaaggcaactcctacagatacagggtggtcaccaatagaatggcctggggtccaaaaaaaggccagtgaacgaaacttaacagaatccagatgtggccttggaagacacatggcagccccaatgcctcaatctgactgggctttcttgatagaatgttgttggacactgagcagggctatcgtgcttttataaaaggttgagtaaaccagagaaggcaggagaaacagaacctctccacagactagagaaacagggccaaccatatcaaatggagagagccatggctcataagcacttttcagcagccctgtcttcccccatgagcaaggggaagaggacacgggcttaataggaaatggagaaggagcaagtcccgaccaaaagattccatgctgtggccacccccggcccgccctgctgacgggtttcaggcgagtcaagtcattcaacccccagcccctgcatacacatggtgttcacataagctcactcctcagcccccagccggcagaaagccggtgtcccagcgccacctgctgactttccaggcctaccgcagggtggccagtggactctgggtgaacacgccccagctgtggaagaaaaaaaatgaggcagcgcccaggcaaggaagcaagtcaggtgacgcctcaggaaggcttcagtgaagaagaatgactaacaccagggcttccactgccctcagcgactcttacccaccagtctggaatcaggaaaacaggttacaactgggagagtcacctagagcagacccgagaaggctgccccaaagggctgccccaagtccattttggtacagctgcgtggccttccctgtagcctcccagcacacagacgctggagaagacgggaagaggagggctagagctgggggaaatggaggccgtttcaaatgagaacatgacttgtggcagctccagcccacgacccagatggagctcacccatcctgaggacagtgcactaagcgcagggcaaaggggcaggtgtgggtctggcctgtcctcccttcttcttgagaacaagtgacacagaccagctgggtttctggggttttgctgtgtatcttttttaaaaccagctatctgaggggtttggggtaagctggagggtagagagcaaccgactgaggtaagacaacttaggcaaaggtagtctgtgattagatgactcaacctaaaaaagaagaaaaagcagctcagcagagaagcacgggcagctccatctgggctaatggcagcgatgggattctaccctggaggggtaaagaggaaacaaaagatgcctgtggatcaagttcaggtcagcaaaaattcagggggcttccacacaaacaggggccttcctgcgactggctgctaaccagcactttgggcctaaccttgaccgtcatttaagctgagtaaggcagagaaggcagtgcaggtcctctgaacacacaaaccccagcccagagggagctgccgtccccaacacactccaagactcaagagggcctctcgctagctgtgcccccgaagtgcaaggttggcaggaagggaacaggagcgactgccggagtcttccacaagtggaaaccagtggctcatccagtgtggtcccctggaggtggccccgatggacccgccttcacaaactgtcatagctcctaagacctgaaaagctgggcttcttggctaaaaagcccaacaagttcaacccaggcacgcacctaaagctgtcgccgtcagcccgggacagcccattcagtcaccaaatgtttcagcgcccttcatatgtgccaggcccttggcactgagctgaacagtctgaaggggaagagcccaggttttccacgatgggcaaccctgccaagtgccacacctcagagctgcgtgtgcaggctgccctgggacccgaggacagcgctatgggtcagccgggaacatggtgtgggcccctcggaacaggctccacagggaagcctcggagattcacgaagaggaggtgccggctgggccggcagctggagggggtgttccgcacagaggtccccaaaatgctcagagaatcgagttgggggagagcatgtgttacgtgaggctctcccatgagacccacatgactgcttcatgacagggggaggccgaagcagagactgtgggggagccgcgtcctggaggatccatgtgatagcgagccactggaagtggggtgcacaggccaaaggggggaaggcaggtggcagggagcccgcttggtctatacgggatggtggtggccccaccacagcagtggtcccaagggttgtgagagagaggcttaggaggtgacatctacaggctgtttcatgggtggagtccagctctgcaggctgaagacttctggaggttggctacttgacaccgtgaaagcgcctcaccctgctgggccacacactgagaaatggccacgatggttgggcagtcacatgggacaagaagaaagggcagagcagccccaggcttctgggtcaagtgacaggactgagacagtagtggcagaggcaggacaaaagctcagaaggctttggctgggaagctgggactctcccactgctatcccaggcagcagcagcagactatggggggccaagggtacagacttgcttctaggtgtgatgtttcctttcaggccaggccccctttcccaattacaaaggctactcgggagctctcaggctaacctcctatgtgttctgagcccagtcccgctgaaaactagtgccaagcaccaggccttctccagaatgtgctcccctccttggccactaacctgctcacatcctccttcttgatcttgcttccctcttccttctgctccccgatcttctatcgctctgctggaggctggaatccatcctgccagcacattccctttgccctggcctcaatgcctctgaagccagcaacccaagctcgactgcccggaagcaccctatcctgctcatctgccaggcctcccctgctcaaccctgctctccctgtcccctcctttccttgctgcccccaggcctggccagaagtcccactctgcaaccagccctcacacctagcacgatagtgttactccatgggcagccagagctccctttccagcagggggctgcgtcctcgcattccgcaagtccacagcagaaccaagatcatctcagactcccagagactggaaaagcctgctgattcaactccacctgggcctctcagctctgtcccctccaccccacttctactaccactgtaccactgcccccgttcaggttcccagcaagtctcactgacaacctccaacttggtctccccacttcaggctctcctgctccactccaacccatacacccttgcaaaatgttaatccacacaggtgactgcatgccagcagtactggaatacccactaggcaggctctctaccacgcagaaaagttgcatacgaagtctggaacccttaactcctaaccatctaacctgctcgggccatgagtacctgctcgcgccatgagtacctgctcgcgttcaagaactgagcctctcagtgggacataaagaacatggaaagaaagagaggtgggtgtggtggctcatgcctgtattcccagcactttgggaggccgaggtgggcagatcacatgaggccaggagtcagagacgaccagcctggccaacagggcaaaaccgtctctactaaaaatacaaaaattagccaggcgtggtggcatgtgcctgtagtcccagctacttgggaggctgaggcatgagaactgcttgaacccaggaggaggaggctgcagtaagccaagactgtgccactgcactccggcctcagcgacacagagagactctgtctcaaaaaaaaaaaaaaaagaaagaaagaaagaaaaagaaaaagaaaaaaatcaacagcaacaaaaaagaaagagacagataataggagtggcatgggtgctccaagaggatcaggaggcccaaagaaagctgactagctgaggccactgtttatgacatcagaaacagagctgcaggctcgacatccaccaatgaggaattgggtagacactcaagaacactcaagaacgctggagaggccaggcacagtggctcatgcctgtaatcctagcactttgggaggatgaggtgggaggatttcttgagcccagcagtttgagatcagcttgggcaacagagcaagactctgtctctacaaaaaattaaaaaattagcagcacgtggtggcacatgcctatagtcccagctactcgggaggctgaggcaaaagggcggggctgcagtgagccatgatcacaccaatgcactccagcctgggtgatggagcgagaccttgtctcaaaaaaaaaaaataaataaataaataaataaatatgctggaaacaggtcagttgtcccagaaaaacattcatgataaactgagtagaacactcaagtcaccaaggggcatttaaagcatgtggtgcttaaaagccccgtggttaactttttttaaacacgggaatgtttttaaaaagcatgtggaggctgggcgtggtggctcagctgccgcactctcccgtgttcccatccagtagcctgatccaaaaaagccatgaggttggtcttgcgtgacttcttagaaaaggaaacggtgatcccagagatcagtgtggattcaccagttgcccataagcgatctagttaatcatttctggaattttgccagaaatatatactccttgctagtctaagagttaaatctaagatggtggctgtgaccctagaggaccttggctttctgtgtgatgctcttgtccagccttatggccacacagcccatttgcagcttgcaggaaacactgaaaaaacaaagcaggccaggcgcggtggctcacgcctgtgatcccagcactttgggaggctgaggcaggcagatcacctgagctcaggagtttgagaccagcctggccaacatggtgaaaccccgtctctactaaaaatacaaaaaattagcagggcatggtggcgggcgcctgtagtcccagctacttgggaggctgagacaggagaatggcgtgaacccgggagacagagcttgcagtgagccgagatcgagccactgcactcctgcctgggcgacagagtgagactctgtctcaaaaaaaaagagtgagccccctaaggcttctatgtgtatgtgtggatagagccaatccacatggcagccactcatgtgggttaggaccacacctaactacactgttctgccagcaccttccccacacttcggcatctggtcgttaagaacagactcagactggcaagcatcatgctaaaaatccatctacactccatctatagaaggctgacagaacttctccaggaattcacagcagtcaccaatgatcccgctcttcttttccaaaagcatacaagctattctttctagagcatggctggagatcaaagtcaaccctccccaggtcaattcctcatctaccttctcctccctttggaaattgggatgtttgccaggctgcagtctgccagtatctctcccactctgcaaatcctcaagcatcggtggcaatgccttctgcagatgatctcaacagcttctggacataatctcatcaagtacatcctttagggatgccactcttgcccacctgtaatttccattttctcatcctagtgtttcctttgcccttgaccacctaccctccatctccttccttacacagacatataaaagggactgccttctcctcacttctccatgtctttcatgattcagagctcccggcaggttttcaccttcccgatactattcttttttttttttttttttttttttgagatgtcacccaggctggagtgcagtggtgtgatctcggctcactgcaacctctgcctcccgggttcaagcaattctcctgcctcagcctcccgagtagctggcactacaggcacctaccaccaagcccagctaatttttttgtattgttagtagagactgggtgtcaccatgttggccaggctggtctcgaactcctgacctcaggtgatccacctgcctcggcctcccaaagtgctgggattacaggcctaagtcaccgcacccagcccacccctcccccataccattcttaaagctctagatgcttttctggtagatggcctagtttcctctctttccctctcaatgtggtcttttttcctcattttgctgactgtcacactcagaattctgggtttgagactcagtctttcagatctgcttccctttcagcctcagaccacaagataatacttgtttggaacttcctgaaaaatttagggtatgtgtctgactcctcccagccttcctgactttcctaagtttgaagacagcaagcttgtagatcaaatctgtgatcaaacccattatcttgaaaaaaatgtgtttgccttttctagctccacccctctttccaacttggtcgcagagagtaccagatcatctaaacaacagattttaagacaagtagtcatcgtagcgcctagtaaagcaggacacaccaggtgactagagagcaagaatctcctaggcatggagattcttgagtctcggggcacaaaaccaagtggggaataactgtccatgagcctgagaatcacttggtgctatggtctgagtgcccttcaaacttcatgtgttggaatttaatcctcactgccgtagcattaagaggtggggtcttttgagaagtgattaagtgatgagagctccaccctcaaagcaagcgcctttccaatgccttcatacatggtctgagctcccatccacctcccagccaggccctgctgatcagaacggctatgtgaagcaggaggcagcaaacagggccccaggctcaaataggcacttcgtagtggtctagttttgcccgactagttacccttagccttgattaaggtacttagttttaccaaaaaaatcatcagaaatactctggctgccatggaatgtaacatgtcctcattacgagtttcacgtggggaaggccctgaggtgaggagaggcccagcctcttcgtgccacttttacctgctgtccctaggtcaacaccccggacacaaagagtcccccattcagtcgctcccttgtgagctggactctgaaggtcctctcccagaggagggcaaggccttaccgttacatctcactctccatgcaaacagaccgtgagatagtcatctgtttgcctgagagtatgtggtgtgtgagggtcttctgatatttcaggcagccctctcctactctccacgctgcctctggaggtcaggagaaaactatgtggcttccctaacacagacagggctt

SEQ ID NO: 115 - DNA, 4212 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcacggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcatctagctgtctgctcagacagaacccctacatgaaacagaaacaaaaacactaaaaataaaaatggccatttgctttttcaccagatttgctaatttatcctgaaatttcagattcccagagcaaaataattttaaacaaagggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcggtgtgtgtctgttcacttttcctccctcagtgccctgcatttatgtcattaaatgcgggctcacaaaccatgcaaatgctatgagatgcatggagggctgccctgtaccccagcacttctattgtctggtgatggcaccatctctgatctttcaaa

SEQ ID NO: 116 - DNA, 1601 bp, Homo sapiens
ttcctgccgttgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggg

SEQ ID NO: 117 - DNA, 485 bp, Homo sapiens
tttttttttgattactgaagaaaatgtactttattaaacagaaggctttctctcaaggccaagcccagtccccatgtgcagaaggagggtgtcagggtcacaggaacacctgcaaactggaagagaactcagtggtacttatgggccagggcaatggcgacagcagacaccagcttctgccaggcagcctgcacttcaggggtgaactccttgcaaagtgagtagccagaataatcaccttcacgttacccagagtttgaagtcttcaagatccacatgcagcttgtcacagtgcagctcattaacttacaaagcggcttggagggtgcccatttgttttataagcatctcaagagaaagtaacaccttctttgcttgggcctttctttttggggttgcccccaagggcaaagggaacaaacgggttctaaaactttcaaaaatttttggttcccgggggaacaaaaaaggagagtggcccaagg

SEQ ID NO: 118 - DNA, 1002 bp, Homo sapiens
cgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccactgggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatcactagcttctcc

SEQ ID NO: 119 - DNA, 1405 bp, Homo sapiens
ctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaataaccagtatgaaagtcgttgcgccgtgaatctctactgtagccatgaatttatggacagttag

SEQ ID NO: 120 - DNA, 1322 bp, Homo sapiens
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctaaaaaaaaaaaaaaaaaaaaaaaaaa

SEQ ID NO: 121 - DNA, 4343 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagcccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttctttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtc

SEQ ID NO: 122 - DNA, 4910 bp, Homo sapiens
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctcgacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaa

SEQ ID NO: 123 - DNA, 1418 bp, Homo sapiens
aactgtgcgaaccagacccggcagccttgctcagttcagcatagcggagcggatccgatcggatcggagcacaccggagcaggctcatcgagaaggcgtctgcgagaccatggagaacggatacacctatgaagattataagaacactgcagaatggcttctgtctcatactaagcaccgacctcaagttgcaataatctgtggttctggattaggaggtctgactgataaattaactcaggcccagatctttgactacagtgaaatccccaactttcctcgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttgga

SEQ ID NO: 124 - DNA, 487 bp, Homo sapiens
  misc_feature (433)..(471): The "n" residues at positions 433 and 471 are t and c, respectively, according to the corresponding sequence (AQP3 gene) in the Entrez Human Genome Sequence Database.
aggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccaccctacttcccaaaagcctgtagaagcccccacttagaaaaaaagggcagacatacacatacacagaaacacatatctatctggcagctcctccatgtgaagcccctggaaacatacacacccngggacttttcctctccttatggcacagatgggacaggntggcctttcccctgtt

SEQ ID NO: 125 - DNA, 2587 bp, Homo sapiens
ggcacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggcttccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggccagatcattcgtgagtgtgcgagtgtgtgtgcacatgttacaaaggcaactaccatgttaataaaatattcaatttg

SEQ ID NO: 126 - DNA, 844 bp, Homo sapiens
  misc_feature (4)..(825): Each "n" position in this sequence may either represent at least one nucleotide selected from a, g, t or c,  or contain no nucleotide.
  misc_feature (488)..(752): The "n" residues at positions 488, 502, 587, 606 and 730 are t, a, t, t and a, respectively, according to the corresponding sequence (GEF-2 gene) in the Entrez Human Genome Sequence Database.  No residue exists at "n" positions 652 and 752
tttntctttcaaaaactaaacccggcctttataaaagtattttgtgtggtatttatttaccttaatagctccacaaagaggaacaaattagctcagtccaacatgattggcagttggcatattctagtgaagcaagtgttctgactgctaaggatttaatttggataattttaatacttagccatctaacacttcaagcataacccaaaataaatgcatcaccttccctttcactttaataccgcacctacctcacttcgatatagaaatatcattcaatatgatttccagaaggacaagtttcctggagaatacaggcgtgaggacactgcacaaaaagaaaaactcaaaataaaactctgtgtgataatttactagtctaaggaaacaaaaccttccaatatattaagaaataaatccagttacaaatgcgctaataggtctatgtgaagaggttctggtataataactgaaaatggctggctatntacaagatacacangcagttacggtgcacctagcccagcaatggccctcagaagccaaaaagtgtctcttcgctgtaggccacatataagaatccatcntcatctttttccctctcgnaaagcctgccccatagtaggcttgactgggggactgtcttatccancaacaggaagatcgccttttcagaaggaagctggatcctttttcctgtgatccacactgaactgaagccacagtgatntccagatgaaaccaagtacttnccgttggcaatgtcacaatcttgagagcttgaaacctttttcanantaacccggaccctgtgnggataatttngtctgatatttggggactc

SEQ ID NO: 127 - DNA, 597 bp, Homo sapiens
  misc_feature (367)..(367): Position "n" at 367 may represent at least one nucleotide selected from a, c, g or t, or contain no nucleotide.
  misc_feature (475)..(556): The "n" residues at positions 475, 509 and 556 are c, g and c, respectively, according to the corresponding sequence (HBD gene) in the Entrez Human Genome Sequence Database.  No nucleotide exists at "n" positions 503 and 508 according to the same
gacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggntcttgggcaatgtgctggtgtgtgtgctggcccgcaactttggcaaggaattcaccccacaaatgcaggctgcctatcagaaggtggtggctggtgtggctaatgccntggctcacaagtaccattgagatcctgngactnntttcctgataaccataagaagaccctatttccctagattctattttntgaacttgggaacacaatgcctacttcaagggtatggcttc

SEQ ID NO: 128 - DNA, 1011 bp, Homo sapiens
gatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataaaaaaaaaaaaaa

SEQ ID NO: 129 - DNA, 3629 bp, Homo sapiens
ccggctcgacggctcggtcaccgcctcgctgtcgtcgcggcgcccccggccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaagaggacaggctcaatcaaatggactttaaaagaagatccagtcctgcaggtcccaacacatgtggaagagcctgcctttctcccagatcctaatgatggcagcctgtatacgcttggaagcaagaataatgaaggcctgacgaaacttccttttaccatcccagaattggtgcaggcatccccatgccgaagttcagatggaatcctctacatgggtaaaaagcaggacatctggtatgttattgacctcctgaccggagagaagcagcagactttgtcatcggcctttgcagatagtctctgcccatcaacctctcttctgtatcttgggcgaacagaatacaccatcaccatgtacgacaccaaaacccgagagctccggtggaatgccacctactttgactatgcggcctcactgcctgaggacgaaggggactacaagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgcccactctgtatgttgggaaatactctaccagcctctatgcctctccctcaatggtacacgagggggttgctgtcgtgccccgcggcagcacacttcctttgctggaagggccccagactgatggcgtcaccatcggggacaagggggagtgtgtgatcacgcccagcacggacgtcaagtttgatcccggactcaaaagcaagaacaagctcaactacttgaggaattactggcttctgataggacaccatgaaaccccactgtctgcgtctaccaagatgctggagagatttcccaacaatctacccaaacatcgggaaaatgtgattcctgctgattcagagaaaaagagctttgaggaagttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctgagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggagatgaggaaaccagcgtggtgatagttgggaaaatttccttctgtcccaaggatgtcctgggccatggagctgagggcacaattgtgtaccggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagagtatgtggagcagaaggactttgcgcatctcggcctggagcccatcaccttgctgcagcagaccacctcgggcctggcccacctccactccctcaacatcgttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctacctacacggtggacatcttttctgcaggctgcgtcttttactacgtggtctctgagggcagccacccttttggcaagtccctgcagcggcaggccaacatcctcctgggtgcctgcagccttgactgcttgcacccagagaagcacgaagacgtcattgcacgagaattgatagagaagatgattgcgatggatcctcagaaacgcccctcagcgaacgacgtgctcaaacacccgttcttctggagcctagagaagcagctccagttcttccaggacgtgagcgacagaatagaaaaggaatccctggatggcccgatcgtgaagcagttagagagaggcgggagagccgtggtgaagatggactggcgggagaacatcactgaccccctccagacagacctgcgtaaattcaggacctataaaggtggttctgtcagagatctcctccgagccatgagaaataagaagcaccactaccgggagctgcctgcagaggtgcgggagacgctggggaccctccccgacgacttcgtgtgctacttcacgtctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtatgagatttctcattgatcacagatgtgcccagagtagcccaggtcactgttaactagtgtttctgcagaggcagcaggagccagcccggaattc

SEQ ID NO: 130 - DNA, 2927 bp, Homo sapiens
gaattccccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccggggcctccggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcttagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaagggtccccctggtgctcttggtttgaggggacctaaaggtgacttgggagaaaagggggagcgtggccctccaggaagaggtcccaacggtttgccaggagctataggtctcccaggtgacccaggccctgccagctatgggaaaaatggccgagacggtgagcgaggccccccagggctggcaggaattcctggagtgcctggacccccgggacctcctgggcttcccggtttctgtgagccagcctcctgcaccatgcagctggtcagcgagcatttaacaaagggcctgacccttgaaaggcttactgctgcatggctgtctgcatga

SEQ ID NO: 131 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 132 - DNA, 887 bp, Homo sapiens
cgctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattaagcatttcaggttgtgcattttgtgtgatgcatgtagtagcctttcctgataacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaagtctctgtgcttgac

SEQ ID NO: 133 - DNA, 115 bp, Homo sapiens
  misc_feature (61)..(61): No nucleotide exists at "n" position 61 according to the corresponding sequence (RNAH gene) in the Entrez Human Genome Sequence Database.
ctaattcatgttgtagcacttacagatcatatagtacaattatttgtctttatgctctccnaggaaaaatctgagacagaaaatttttcacccctatggataggttttcacctgt

SEQ ID NO: 134 - DNA, 1120 bp, Homo sapiens
acttcttcgcaccagggaagccccacccaccagaacgccaagatgtccagcaagcgggccaaagccaaggccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggccatacaacttcaccatgttcctcaccatgtttggggagaagctgaacggcacggaccccgaggatgtgattcgcaacgcctttgcctgcttcgacgaggaatcctcaggtttcatccatgaggaccacctccggaagctgctcaccaccatgggtgaccgcttcacagatgaggaagtggacgagatgtaccgggaggcacccgttgataagaaaggcaacttcaactacgtggagttcacccgcatcctcaaacatggcgccaaggataaacacgactaggccatccccagccccctgacacccagcccccgccagtcacccctccccgcacacacccgtccataccagctccctgcccatgaccctcgctcagggatccccctttgagggttagggtcccagttcccagtggaagaaacaggccaggagagtgcgtgccgagctgaggcagatgttcccacagtgaccccagagccctgggctatagtctctgacccctccaaggaaagaccaccttctggggacatgggctggagggcaggacctagaggcaccaagggaaccgcattccggggctgttccccgaggaggaagggaagcctctgtgtgccccccaggaggaagaggccctgagtcctgggatcagacaccccttcacgtgtatcccacacaaatgcaagctcaccaaggtcccctctcagtccccttccctacaccctgacgccagatgccgcacacccaacgccaccagccatgggagtgtgctcaggagtcgcggggcagacgtgacatctgtccagagggggcagaatctccaatagaggactgagacaacatg

SEQ ID NO: 135 - DNA, 1642 bp, Homo sapiens
gaatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctgtctgagtttgatactgtggggattcagtttaggcgctggcccgaggatatcccagcggtggtacttcggagacacctgtctgcatctgactgagcagaacaaatcgtcaggtgcctggagcaaaaagg

SEQ ID NO: 136 - DNA, 479 bp, Homo sapiens
  misc_feature (441)..(441): The "n" residue at position 441 is nucleotide g according to the corresponding sequence (SLC11A1 gene) in the Entrez Human Genome Sequence Database.
cggctcccctgaggaaacagcaaataatttgggcctcagaggcacagactcttgggttccttatgacctggtgcctgacggagaaagaagtgcgccgccgttttactgtctggaaaatgggttgcaggcggaacagaaaggctgcggcgaataggagcggaccagaccctggtgtaggggtcttctggatgctttagagacttcgtgccttcccggttcccattccctgctcctttggacgagaagggaactagtatttatttaactttaatcaggccgggtttggtggctcacgcctgtaattcccagcactttgggagacggagatgggcggatcacttgaatccagcagttcgagaccagcctggccagcatggcaaaccccgtctctgctgaaaatacacaaattagctgggcgtggtggcgcgcgccactcccggngctgaataaagagaatcgcttgaacccagaaggtggag

SEQ ID NO: 137 - DNA, 2240 bp, Homo sapiens
ccccgcgggctgcagcgagccaggcatgctcactggcgcaggcccggcccgcagcccgagcaggaagcgccggcgtaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgcccctactcctgcccatgtcctggtgcttcctgcaagtggcaggggtccctggaagctgtgatgtcccatctcatgcacgcccacaagagcattaccacccttcaggaagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgctcgattcatgacggtgtggctgcggccatcatgaacagcgactgccttgttttcgacacagccatagcacatctttttgcagataatgggaaccttggaatcaatgttactatttctacatgttgtccatgatgtgacttccgtaaaccttcaaaattatttgggcatactgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcagtgatctttcaacagtaatgtttgagaattactgggttaaattgtggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacc

SEQ ID NO: 138 - DNA, 464 bp, Homo sapiens
  misc_feature (68)..(68): The "n" residue at position 68 is nucleotide c according to the corresponding sequence (S100P gene) in the Entrez Human Genome Sequence Database.
cctgccagcccccaggaggaaggtgggtctgaatctagcaccatgacggaactagagacagccatggnatgatcatagacgtcttttcccgatattcggcaagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgaagttcatcgtgttcgtggctgcaatcacgtctgcctgtcacaagtactttgagaaggcaggactcaaattgatgcccttggagatgtcacagattcctggcagaacattgggtcccaggcttcccaaaagtgtttgttggcaattattcccctaaggctgagcctgctcatgtacctctgattaataaatgcttatgaaatgata

SEQ ID NO: 139 - DNA, 16689 bp, Homo sapiens
  misc_feature (4125)..(13976): Each "n" position in this sequence may either represent at least one nucleotide selected from a, g, t or c,  or contain no nucleotide.
  misc_feature (4125)..(13976): The "n" residues at positions 11593, 11595, 11934, 11937 and 13976 are c, t, t, t and g, respectively, according to the corresponding sequence (TNNT1 gene) in the Entrez Human Genome Sequence Database.  No residue exists at "n" position 4125
  misc_feature (4125)..(13976): The "n" residues at positions 11593, 11595, 11934, 11937 and 13976 are c, t, t, t and g, respectively, according to the corresponding sequence (TNNT1 gene) in the Entrez Human Genome Sequence Database.  No residue exists at "n" position 4125
gtgactccatgtctattacccagggcttaggcaggagacagatgggaagactgcaggtggggctcccccaaagccacacagcaggttggggaccagatgggtctcccatgtgaagcactcttggctgtgttattgaaaagaatcccggggttcatgaatttggagagcggagctttgtttcttaagaagcggatcacaacctgaagaccagaagcatggcttcttgccaaaaaacaaaagcaggcactttaagggagggaagggcaaggcaggaatttatgctgagtgggttagctaagtgcacgtattcaactggttatagaaggagctatgaatattcatggacaggtggacacatggacacacgcatgtgtgacaagcaaacactcatttttttttttttttgagacggagtcttgctctgtcacccaggctggagtgcagtggcacgatctcagctcactgcaacctctgcgtcctgggttcaagccattctcctgcctcagcctctccagtagctgggattacaggcatgcaccaccacgcccagctaatttttgtgtttttcgtagagacggggtttcaccatgttggccaggctggtctcgatttcctgacctcgtgatccgccctccttggcctcccaaagtgctgggattacaggcgtgagccaccgcgactggccgcaaacacattttacatgcatcccaccttcacttggtggtggaggcttaacatttaagtgcattccattgaatgcattcgtatcgaaacacgaagcagggatatgaagacactcagtgcacagcctctgtcaacagccagaaccagtccgtggtctgcggcatcttatcaggagaaagttactgaaatcagtctcttgttcaactaatgctgtagttatgccttgtggaacagggggttcagctagtcagcatctggcaatggatggctgcaatggttgtaatattgcttatcttgaggccggtgcttgtttagctgctagaaaaaggaaaagccttgtggcagttggaacatagtcgattatataagtgtagggatgcgtggcttaacccttgcctggcatggccttaggtcttgtttataatttggtatcttattgccacaaacagttcattccatcagtcttctgatctctattgtcacagctcctctggcccatgtggagtgcacagagatgccaagactaaaggtcaaagagagagagacacagagaaacagacaggcagagagacatgaccgacaacagagagactgagttgggagtagagagagtaggagccaggcaaagacccaaagagagagggagaaaataccacaagatgcatagaaggaagtgcaaagaaaggagaaaagagagacagagatatactcacagcaaggtgcagagacatggagaccctataagagatggaaatggagagccacagagggggaactgcgggcactaagagagacatggagagaactagaaagatagagacgtgaacacagacacagagacccagagccaaaaagagacagaaatggggtcataggtggacagaaatgcacagagagactgtgagcccccacagacacaaacgctgagaggggcagacatgcagagacacccacagaaatgcagagacaaaaccacccggagacacatgccgagaaacacactgaggggctcagaaagcgacagatgcagagagagcccaagacagacccagcaaggggccccgagaaatgcacagaaacacaaagaccgagaccaccagagacagaggtacggagaggcggggagggtgaggaagcctgctctccagggctggcttgaacctagaactcaaggtcatggcttggctgggaagcgggagggggataccaaaaaagatcagcgttagatggaggtggggagggagggtaggtttcaccctaattgacaccccaccctccccctccccctccccacacctgcttcccggctttagtgcctgttgtcaccaggatggaatcctggcggcagacaaaggggtgggggtgggaggaggagacaaaaagatggacagagacagaggaggagactaagaagtagagacagacacacagaagtagagacagacacacagagacacacagatggagagccacagagacaacagaaatgggggtccagaaagagacctagatagaaagagggaacagagagaagaaaacaggaaacattccttatagcccatgtgtcattagtaggtcctccaaggacctactgtgtgccgggcatggggacgtcaaagcacagggagctataagggaggtagttggagcaccacgggagcctggggtgtggggtgggagcaggggcggggctcctgggccatgcagatggggttggcatggggttggggaggggcccacggaggcttctggactctgagtgtggagccaggggcagcagggctgtctctgaactcccaggcttgtgtttgagcaaaggaattctctccccctccctctcccctcggggcgggcccgagcctccagctataaactccccggagcttcagtgccctcagcaaggctcagcctcaagattcacagcatctcagacacagcctaggtaaggggctctgcggagccctgtggtcttcaaaaaccatgtccttgggggagggggcaggaggcaggtggggaagatgtcgggtgtggagaaatggtgcagaggtaggtggggcatacaactggaggtctgggaacttgagaggctcagactttagggggactcaggatagaggggaaaatactaggatttgtgggttacacaaatcctaacccggggctgccaggacttggatgtcccagaataaaacctcctaggatcttggggttctgggaatctgggggaaatctcagcagtcagggatatctggacttggaggtcaaacaatctgggtgtcaggatttggggcctcagactctgagggtatcaggaattgggggggtctcagaagaaattggggttttggtagtggagggctcggaatctgagacattatgatagaaagcatgaaaacttagagtgccattatctggggtatcatgaactgggcctccgagtttgggtatcaagattttgggggtctcatattcttgaggtttcagattttaggaggtctcaagacctgggggtggtcttaggatgtcccggcccatatctggactatcaagaactgggatttcagaatccagagctgtgaggacttgctggcctcagaaacacgggcatcataaatcggggtctcagaatctgtgggtattgggatttggggctaggcaccctgtggcctagggtgtctcaaagactttgaggtctaagaatgtaggggtcagggtgaggtctacggacagaaggtgccctttatgcccctgccccctacgtgatgtatgggaaggtgaaaggggagacaggtggggaggaaaccagccagtggggtggggcgagtgggagaggggatgcgggtgactaattctcccagaagccccccttcctcaaatcccttcttaggaaatgtcctcggtttcaccatctatgacatccccccaaaatagctcctgggggtggggcagctattgtcttcaggccactgtcccttctcaaatgcctcttcctaatcccaactggatcaggttcccatggacttgtcataagacaaaagaggacagctgtgctgagggggcagggtctgcagcctcctggctgtgccaggaccacacctaccaaggtctgtcctcatgcatgctttaggacagccggccccctccctcagacccaagagtccagacctgagccctcctccctcagacgcaggagtacaggcccccagccccctcctccctcagactcaggagtccagactcccagcctctcctcccttagatccaggagtccaggccccagctcctcctccctcagacccaggaggccaggcccccagaccctcctccctcagacccaggcgtccaggcccgcggcccctcctccctcagacccaggcgtccaggcccctggcccctcctccctcagatccaggagtccaagcctccagcccctcccccccnagacccaggggtccaggcccgcggcccctcctccdddaagacccaggggtccaggacaacccatctcagtannnnggagtccacanccaccctcccacacaccccccannnanatcctccctaagacccaggaatccggcccccagcccctcctccctcagatccaggagttcaggaccccagtccctcctccctcagacccagaagtccaggccccagcccctccttcctcagacccaggagtccaggccccagctcctcctccctcagacccaggagtccaggccccagctcctcctctctcacacccaggagtccagaccccagctcctcctctctcacacccaggagtccagacccaggagtccaggcccccagcccctcctccctcacacccaggagtctaggtcgccccctccttggggccccaccccactgggcctcttctctctggtccttaggccgcaccaggatgtcggacaccgaggagcaggaatatgaggagtgagtgctgcactgggaggggttggggcgtgcagtggtggagaggctctcccaccccaggtctaactctcccctccctcctctctccccacacccgtccgcagggagcagccggaaggtgagtagggagtgggccggccctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaaggtgaggtcccggactccgcaggtctggagctggggggtgggggggcggggacgctgggcccgggaggagggggcgggatggggctcccgacggcctcggctcccggtcctctaacagcctctcacgtctcttccctctctcccctcccgcgcccgggcgtggccgctcccccctcgctccccaaaccctcgctgctcctccctcccctccccagcccccgaagagccggagccggtggcagagccaggtaaccgcggctgcttcgcttcccgagaccgatgtcgggggcccggggggacccccgatatcctcgggccccaacctccaagaccacccttccctccctccgcccccataacccgcccccaggcccggtcctttaagcccctgagagctcctgcgccctctcggggccgggaagggaaatggccccgcagtggctttaaccctttcccttccttcttaaagggaccgacacccaagccttcttccccagtctggaggaatctttacagaagggttggatgtttgcggagaagcaccaccccatccccccttatcttcgcctccaaccttgtctgttattttctcccccatatacattcaaaggttggggcttggaatttaggattgcagaggaggcgagcgctgggagtcagggtctccaaggtcgggccgggggcgggggggcggtggggcggtgggcagggggcgagctggggagagagcgctggggtcactgaatgaagacagaggttgggaccccctgcactgctgggtcctaatggaggagagcaggagctctgggcatataaatagagaaaggtctgggggtttgcactcctgggtgtgcagacagtgggggtggggggtcccacaccagttctgaatgtatatctgatgcgtgtgaccctcttcctcctttacagccaccctgactttccttccctcttttcttctccccatcccccctcctccagaactggactccagagtccttccctggtgtcctgggggccgaggcttggggggtccctccccagggtgtgtcaggcctagcccctctcctctaaactcttgctaattatctctttttatcccccaccaccaacagaagaggaacgccccaaaccaaggtgagatcctacagggtggggggccccagtcatacatcttcctaaatattccctctacccccagagacaaggtgtgagaaaggcagagatggagggaggaaattgaaacagcagtcgacatttctcctcctcctcctcctccctccccctttccctcctccctcctctccctcctcctccctcctcctcctccacttcctcttcttccccttccccttctccttctccttccccttcttcttcatcgtggtcatagtctccaccctgttacccaggctagagtgcagtgacccaatcctggcccactgcctcaacatcttgggctcaagcaatcctcccatctcagcctcctgagtagctgggaccacaggcatgtgccaccacacctggtttttttttttttttctttttgtagagatgaggtcttgctatgttgcttaggctggtcttgaactcctatcctcaagcagttctcccaccttggcctcccaaagtgctgggattacaggcgcaagccaccatgcccagccagtctgtttccttctttccacccagtggtccctcttcccctcgcgcctttaccatcaccccagcctcctctctggcctccctgcctacaacttgtggctcatcctcctccatgactcgagagagacttttctaacaccagagctaaccctgcccctcctctgctcagaatctttcctcaactccccactactcttaagacgcagtcaaagcaactagcctgcattcaaagccttccccatctggctccagcggacctttccggcatctgccttccccactgacagacacacagcgtttcatggttctctagccatgcctgtgctttcatacccctgagcctttgcacacactgtgccctctgcctgcgcagcggcaggtgggaggatcacttgaggataggagttcaagatcagcctaagtaacaaaatgagatcccccacatctctacaaaaaattttaaaaaattagccgggcacagtggcacacacctgtgattccagctactcaggaggctgaggaaggaggattgttcgaacccaggatttggaggctgcagtgagctatgattacaccactgtactccagcctgggcaacagagcaagaccctgtctctaaaacataaataaaaataagggaatggggccgggcgcagtggttcatgcctgtaattccagcactttgggaggctgaggggggcggattacctaaggtcaggagtttgagaccagcccggtcaacatggtgaaactctgtctctactaaaaatacaaaagaattagccaggtattgtggtgggcacctgtaatcctagctatttgggaggctgaggcaggagaatcgcttgaaccgggaggcagaggttgcagtgagtcaagatcgtgtcattgcacggcagcctgggcaacaagagtgaaactccatctcaaaaaaaaaaaaagggggtggggtggggtgggggaatggactgagagggattccaaggcaaagggacaggacttggggattgttgggcaaggggagggaagcaatggggacaaccccgaagggtctctgggctggggaacaaagtggacagtggggctgccatctccttctcagagaagttggtgagctccatcaggacgtcatgtgtgggaaggtgggaaaagttcaggagatacctgttagcttgagtctggggcttaggagagagtctggaccagagacagttggcgagtcctcagcagttgatgatacctgaagtcattggagtgaatggcattgatgatgagaaaagggaaaaggaaagctcactggcagctcacggggctgtcggggcaggagatagggatggaacagccagaggggtgggaggcaagccggtattcattcctgtacaatatggtaagccatattttattcccacacatgacgccctgatggagcttatcgacttttccaagatggagatgacggccctgctgtacacttggccccctggcccagagacccttggggattgtcctcacctcttccctccccttgcccagcatcccctaagtcctgtctgcttcatcttggaatcgctcttcactgtctcagaaacccagaaaagagaattccaaggaagtggcaggaaatcagagcaggctgagggctgagcctcagagcggcaccacccaatagaaatagatggcaagccacacacgtcacttacaatttcttactaaaggctgggcgcagtggctcacgcctatagtcccagcactctgggaggctgaggcgggaggatcacttgagctcagaagttcaagaccaccctggacaacatagtgaaacgccatctcttttttttttttttgagatagagtctccctctgtcacccaggctggtgtgcgatggcacgatctcggctcactgcaatctctgcctccggggttcaagcgattctcctgcctcagcctcctgagtagcagggattacaggcacgtaccaccatgcccagctaatttttttttttaatttctagtagagatggggtttcaccatgatgcccaagctggttttgaactcctgacctcaagtgattcgcccaccttggcctcccaaagtgctaggattacaggcgtgagccaccgcgcccaggctgtgaaacgccatctctacaaaaaatttaaaaatggctgggcgcaggggctcctgcctgtaatcccagcactttgggaggctgaggcaggcagatcgcctgaggtcgggagttcaagaccagcttggccggcacggtgaaaccccgtctctactaaaaatacaaaaattacccaggcgtggtggcaggcgcctgtaatcccaactactcgggaagctgaggcaggagaatcgcttgaatctgggaggtggaggttgttgtggtgagcagagatggcgccactgcattccagcctgggtgacagagtgaggctctgtctcaaaaaaaaaaaaaaattcttactaggcatattttttaaagtacaacaatataggaaaaattaattttcatagcacagtttttttaatctgttatataatgttttatcatttcaacatgtaatcagtataaaacatgattagtgccgggcgcggtggctcacacctgtgatcccagcactttgggaggccgaggcgggcggatcacgaggtcaggagatcgagaccatcctggctaacacagtgaagccccgtctctactaaaaatacagaaaaattagccaggcttggtggtgggcgcctgtagtcccagctactcgggaggctgaggcaggagaatggcgtgaacccaggaggcggagcttgcagtgagccgaggtggcgccaccgcactccagcctgggtgacagagcaagactccgtcaaaaaaacaaaacaaaaccaacaacaaccaaaaaacatgagtagtgaggtattttaccttcttttgtgtgtttcactgacagcccgcctcagctgggaccctccacgttcaggagcctcccggggctggcggctacctcactggacggcacatcccggaggtgggaggtggctcagggaggtcgggccactcatggtctctgtgtttctgtccactcagccgccccgtggtgcctcctttgatcccgccaaagatcccagaaggggagcgcgttgacttcgatgtaagtgacaagagacccctccgcaggcgcagttgctagtctttaaggggcctttgtgtcaatcatgaaaaggcgccggccgggcgcggggcctcatgcctgtaatcccagcactttgggaggctgaggtgacccacctgaggtcaggagttcgagaccagcctggttaatatggtgaaaccccgtctctactaaaaatacaaaaaatagccgggcgtggtggcaggtgtctgtaatcccagctactcgggaggctgaggcaggaaaatcgcttgaacctgggaggcggaggtggcggtgagccgagatcgcgccatttcactccagcctgggaggaaaaaaaaaaaaaaaggcgccggtccccactccccactcccgtctttgggaagcctgtccttggaagagctgattagtgtcaaacacgaggcattgctgccacctgctggataccgtcctgggaaacggtccagttcaccatcctgcatgggggaggtgctgggaggctgctgccccctccagggtctcctaggacgggctgcccgtgtgtcctgcaggacatccaccgcaagcgcatggagaaagacctgctggagctgcagacactcatcgatgtacatttcgagcagcggaagaaggaggaagaggagctggttgccttgaaggagcgcattgtgagccgagagtccgggttccccccggtcttcctccctccatgtggatcccttgcatcttgggagatgcagataatagttttcctcctagtacagagctgagccttaggctttcgcgaattcacccaagtcggtggccacactccaatctgtttattagcctactctggggaaggaagactgggggtacgtccctgcacccccttatgcttctccgtttcccaggagcggcgccggtcagagagagccgagcaacagcgcttcagaactgagaaggaacgcgaacgtcaggctaagctggcggtgggtgcctcccctgccctgagagcccaaatgttacttcttcagccggatgcccattttgttattattattattattattattattattactattattmttattctttgaaacggagtctagctctgtcgcccaggctggagtgcagtggcacgatctcagctcactgtaacctctgccttccaggttcaagcgaatcttctgcctcagcctccccagtagctgggactacaggtgcgcaccaccacgcccggctaaattttgtatttttagtagagatggggtgtcaccatgttggccaggatggtcttgatcttctgaccacatgatccgcccacctcagccttccaaagtgctgggattacaggtgtgagccaccgcatccggcctattattattttttattcgtttatttggaaatagggtcttgctctgtcacccaggctgaagtgcagtggtgtgatcctagctcactataactaggacctcctgggctcaaatgattttcccacctcagcctccagagtcgctggaactatatagsstgcgccactctgccccactagttttttttatttttttattttttgtagagacagcattttgccatgttgtccaggctggtcttcaactcctaagctcaagcaatccacctgctttcacctcccaaagtgctgggatgacaggcatgagccatcgtgcccggcctggattctccattttcttntnttccctttttttttaattttaattttttttttttctgagacagtctcgctctgtcacccaggctggagtgcagtgacgcgatctcagctcactgcaacctccgcctcctggttcaagcaattcccctgcctcagcctcctgagtagctgggattacaggcacctgccaccaggctcggctaatttttgtatttttagtagaaatggggtttctccatgttggttcaggctggtcttgaactcctgacctcaggtgattcacccccttggcctcccaaagtgctaggattacaggcatgagccaccatgcctggccattgtcatcattattactattatnatnattttttttttatttgagatagggtctttctatgttgcccacgttgttcccaaactcctgggctcaagtgatcctcctgcctcagcctcccgagtagctgggattacagccacctgcccgtcacccagctgtgaaggggattttgcagatgtgattaaattaaagatcttgagatgggaaggttgtcctggattatctgtggggaagggcaagatcatcacaagggtccttataagaggaaggccagagggtcagactgagagatttgaagatgctgcatggctgcctctgaagatgaaagaaggtccatgggcccagacatgcaggcagcagctggaaaagggaagggaatgaattctcccctagaacctccagaataaattggttctgttcacaacttgattccagcccagggggaccaatttcagatgtctgatctgcagagctgtaagataacaaatctgcattgtttttctgccactaaatttgcaaattatagcagtgataggaaactaagtttaggcgcgatggctgacgcctgtaatcccagcactttgggagaccgagacaagtggatcacctgaggccaggagtttgagaccagcctggccaacatggtgaaaccctgtctgtactaaaaatacaaaaattagctggtaatggtggcacatgtctgtaatcccagttacttgggaggccgaggcaggagaatcacttgaacccaggaggtgggggttgcagtgaacagagcagagattgcaccactgcactccagcctgagtgacagagcgagactccatctcaaaaacagaaaggaaactaattcaggtacggagtgctgggtgtacaaaaagcctcatgtccaccataaggagacggggctcagcctggacaaaccactgtttctggaacattcaatgaagagtttctcgaatgtcgtaatgccttcgctcaatattccagaaccccttcctcaggctcaaggccatcagcctctttaatctccccagtccctggtcttatcaccagttacttcccttgaccccctcaaaacagacattctcatatcctgagactaagggcgactgtggcccagacaggctgagcatctggagtgaggtcgtacagcagagttcactatcggctatttcagggtggagacatgcagaaaaagcaggcatttcttcttctccttcatttcgattttttctgggaggatattaagacccagagaagggggccaggtgcggtggctcacgcctgtaatcccagcactccgggaggccgaggcaggcggatcacttgaggtcagtagtttgagaccagcctggccaacatggtgaaaccgcgtctccactaaaaatacaaaaattagttgggcgcggtggcgggtgcctgtaatcccagctactcaggaggctgaggctggagaattgcttaaacccgggaggcggaggttgcagtgagccaagatcgcaccactgcactccagcctgagcaacagagcgagagtccgtctcaaaaaaaaaaaaaaacagaggggaagggacttgtaggtggtcacacggggagacgtggcagggccgggagggggtacccctgcgtttctgctggttctgatgtcccagcagcctctgcggcactgggtctgctgatccctgtgccccagttccacatcccagggccctcctccctcagtcctacaggggagtccatgaggttaaccccttacttcccacaggaggagaagatgaggaaggaagaggaagaggccaagaagcgggcagaggatgatgccaagaaaaagaaggtgctgtccaacatgggggcccattttggcggctacctggtcaaggtgagtcagcctgcaggagcctgaggtctgagttctgagggggcaggggctgggggccagacctctggttcctaacggaggaggggctgaggcctggattcctgggtctgagggaggaggggctgggccctgaactcctgggtctgagggaggaggagctggggtctggacgcctgggtctganggaggaggggctggggtcctggactcctgggctgagggaggaggggctgagggcctggacgcctgggtctgaagaaggaggggctgggggccagacttctggttcctaatgcgagagggtctggggcttggactcagtctgagaggaggggctgggggcctggactcctgggtctgagggaggaggggctgggggcctgcactcctgggtctgagggaggaggggctcggggcctgcaatcctgggtctgaaggaggaggggctgggggtctggactcctgggctgagggaggaggggctggggtctggactcctgggctgagggaggaggggctgggggccagacttctggttcctaatgcgagagggtctggggcttggactcagtctaagagaagggactgggggtctggactcctcctggatctgagggaggagggagtggggctggactcctaggtctgaaggagatgggcctggggtgcagacctgtggtcccaacatggaaatggtctgtgggatccgacgtgtgggtcccgacacggcagtgctctgtgggatgtggcccccagtttactgttccgcctcccccaccctcaggcagaacagaagcgtggtaagcggcagacggggcgggagatgaaggtgcgcatcctctccgagcgtaagaagcctctggacattgactacatgggggaggaacagctccggtaggtgctgtggggggctcggggtgtaggggcctgggtgtgagacagggggataaaggagctcacacccagatctgggtgggcagatactccgggtctcagctccagtgctatgtgactttgggcaagtggcttcccctctctgggcctctgctgccttctttgtgaaacatgtcactgaacccacttttcgtggctgccgtggcctgtagcatctgacaggtgttaccaaggaagccagacaagatgacttccctcccccaagtttaggagattttgttaactccgtgatgtgccttggagctcaggatgggctgtgccttttacctaaattcaagccaggaatgcgggtgagaattttccagctgagtccctcgcatctatagccaagacagcctgcctctcatgataagctacaggacggcaggctggtgggggcttgccttcaggagcccgcctgtttctccatgttctctggcctgggctgtggctcagaaacttcaaccaccccagagtggcgccgtgatcgggtttgccgcttgcaccgaaagcccctgcccagggctcagtgccagctttgccggctactttgtgatcttgcgcacgttatctgacttctctggggctcccattcctcattggcagaacaaggatataatcacaaaattgacctcacagagctgtgaaagggcagtgagatagtaataataattacaggctgggcccggtggctcatgcctgtaattccagcactttgggaggctaagatgggaggattgcttgaggccaggagttggagaccagcctgggcaatgtagtgagaccccatccttaaaaaaataataattacagcagcagcttcctgtggagggtttacaaccctgtgaggtagatactattattatccttgtgttaatagtgaggaacctgaggcacagagaggttaagtaacccttccagggttgcacagctagcaagtggaagagctgggatttgaacccggcagtctggtgcaatagtccgtactctttgctagtgtgctgtaaagtggcttcatggtaaatgtttaacagctgctctccagggggcaaaatgtctagatttagcacatgcccattcccagggcgtaaatacttccaccttgctcctttcaaactacccgtgtggggacactgagtgtggagacgggaaaggatgtgcacagcaggctcctggaagccctctggggggcgctgtgggccctccttcctgtgcacatggttcatgtaaagtattgttggccgggcgggcgcggcggctcacacctgtaatcccagcactttgggaggctgaggcgggcagatcacctgaggtcaggagaccagcctgaccaatatgatgaaatcccatctctactaaaaatacaaaaattagccgggcgtggtggcaggcgcctgtaatcccagctactctggaggctgaggcaggagaatcactgaacccaggaggcggaggttgcggtgagccgagatggcaccactgcactccagcctgggcgacatgagcgaaactctgtcttaaaaaaaaaaaaaaaaaaaaggctgaggtgagaggatcactagagcctgagaggttgagactgcggtgagctgtgatggtgtcactgcactccagcctgggtgacaaagtgagaccctatcaaaaaaaaaagaaaagaaagaaaagaaggaaggaaggaaggaaggaaaggtaggttttagtccagggctggtatggcaattctacaaaatcagagaccagactcctatgttttctgcttcactcactacttttagcccaatatttccatcctcaaaatcacttagtccaatatagctgctagctccagcctcacatggatgatcaaagcagcaaaaagaagacgcaagagaagagccacacagtctcttttggaagctgcaccagtgacctgctttcgtctgagtagcacccctacctgcaaggagattgggcaagtagatttt

SEQ ID NO: 140 - DNA, 3885 bp, Homo sapiens
ccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcggggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactgctctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagct

SEQ ID NO: 141 - DNA, 6210 bp, Homo sapiens
gcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgctaatattaaattcagatgttttgatcttaaaggaaccctttaagcaaacagaacctagctttgtacagactattttaactttttattctcacaaaatcacgtggagggttattctacttcaaagatgagcaaattgaagaatggttagaataaacaactttcttgatattccgttatcggcattagaatcttcctgctcgttatcgtatccagcaggctgaactgcctcttgatacttggttaaaaaaaattttcaggccgggcgcggtggcccatgcctgtaatcctagcactttgggaggccgaggcaggcggatcacctgaggtcgggagttcgagaccagcctgaccaacatggagaaaccccgtctttactaaaaatacaaaattagcctggtgtggtggtgcatgcctgtaatcctagctacttgagaggctgagacaggaaaatcacttgaactcgggaggcggatgttgcagcgaactgagattgcgccattgcactccagcctgggcaacaagattgaaactctgtttaaaaaaaaaagttttcactaatgtgtacatttttttgtactcttttattctcgaaagggaaggagggctattgccctatcccttattaataaatgcattgtggtttctggtttctctaataccatatgcccttcattcagtttatagtgggcggaagtgggggagaaaaagttgctcagaaatcaaaagatatctcaaacagcacaaataatggctgatcgttctgcaaacaaaaagttacataatagctcaagaaggagaagtcaacatgactctgaacaagctttaacttagaaactttatcatcttaaggaagaacgtgacctttgtccaggacgtctctggtaatggggcacttacacacacatgcacacgtacaaaccacagggaaaggagaccgcccttctgcctctgctcgcgagtatcacgcaggcaccatgcactatgttttcacacacactgggtggaagaagagcttcagcgccagtcttctaatgctttggtgataatgaaaatcactgggtgcttatggggtgtcatattcaatcgagttaaaagttttaattcaaaatgacagttttactgaggttgatgttctcgtctatgatatctctgcccctcccataaaaatggacatttaaaagcaacttaccgctctttagatcactcctatatcacacaccacttggggtgctgtttctgctagacttgtgatgacagtggccttaggatccctgtttgctgttcaaagggcaaatattttatagcctttaaatatacctaaactaaatacagaattaatataactaacaaacacctggtctgaaataacaaggtgatctaccctggaaggaacccagctggtgggccaggagcggtggctcacacctgtaattccagcactttgggaggctgagacaggaggatcactggagtccaggagtttgagaccagcctgggcaacatggcaaaacccagtgtgcttctgttgtcccagctacactactcaggaggctgaggcaggagtatgacttgagcctgggagggggaggttgcagagaactgatattgcaccaccactgcactccagcctgggtgacacagcaaaaccctatctcaaaaaaaaaaaaaaaaaaaaggaacccagctggttcctgtaggtgtgcaataataacaaccagaggaagaaaaggaagacgatttcccagatgaagaagggcagctggaccttcggac

SEQ ID NO: 142 - DNA, 1900 bp, Homo sapiens
acaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtaccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaac

SEQ ID NO: 143 - DNA, 960 bp, Homo sapiens
cccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttg

SEQ ID NO: 144 - DNA, 2500 bp, Homo sapiens
agggtcagtttttaaaggaaaaacaactaactaccttgcaagcttgctagcaggtttaagtgtaataatgtgtgggaatgactgcaccgtgactaacatgcagtgacagcttaattaatgttaacccttatcattatcatataagaatgtgagttacataagagaggagtcctgtcagttcgttctctgctgtgtccccaagaccatgaatcatggctggcatgtagtaggcatttaataatatatgttcaacaagtatttggcagtcttggagggcagaaaaggaggtggggaagatttttaaataacattttttaaaaagtcacattgtcctacaataccgatttttcttgcatatttaggaaattgagggtttttttctaaaacatgcggacatatgggaaataggatgcaacatttgcactaatgtttcagacacagttagaggtttccaagagattttgcgctggggaggctgcttgctacaagctcccaaagctctgggaggacatagtattcattcctccctcagcagaagcggtgaggcaagaggctctggggagcacccagcgttgggcttttagcatagtgtgtcaggtcttcatagtttgggcccagggcacagagaagtcacagctctccggcatcctgtgacctttaccctctttgccaagggaaaatgtggcccaccaaagcaagaaacttgagggcatgggtcaccccagccctggcatctgcccagagcccgagaaggaaggaacaatgatcctccagctacctcacggggctggcacaggtgaccactgccctggcatcacccagctgtgtccggcagcctgaaccccatctgtggggatgcgaggaggaaaatacaaaagtccttaggtgaacactgagaaggcagatgcagcagaaacctccaggccagaactacccagtcttggacctatggtggagatagagcatagctggcgatcatgtgtacttacactctaaggtcacctggttgcactatggcctcatctgtggctctgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggtgagtgagtgcagacagatggggcctggtgcccttgagcagttcccgggtctcagctgccacacatctcatagccggtgatgctgggggaagcttacgcagtcacagtactggcttcttcctctttttctttccatacaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattatcttgccaagtttaggctgggcatggtgactcgtgcctctaatcccagcattttggggggctgaggctggtggatcaccggaggccaggactttgaggccagcctgaccaatatggcaaaacctcgtccctgctgggggtacaaaaattagccgggcatggtggtgtgagcctgtagtcccagctactcaggaggctgggacaggagaattgcttggattcgggaggtgggggttttagtgggccgagatcacgccattgcactccagactgtgcgacagagcgagactctgtcaaaaaaaaaaaaaaaaaaa

SEQ ID NO: 145 - DNA, 1110 bp, Homo sapiens
gacagagcccgggccacggagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgccttacaggaacagaagaggaaagagagacacagctgcagaggccacctggcttgcgcctaatgtgtttgagcatacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtaagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggcattttatgtctttcttgtaagatactgccttgtttaatgttaattatgcagtgtttccctctgtgttagagcagagaggtttcgatatttattgatgttttcacaaagaacaggaaaataaaatatttaaaaatat

SEQ ID NO: 146 - DNA, 3224 bp, Homo sapiens
cgaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagcattggaacacgggaggtagtcacccagaaaaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaagatgtccagccaccg

SEQ ID NO: 147 - DNA, 3136 bp, Homo sapiens
  misc_feature (1734)..(1735): The "n" residues at positions 1734 and 1735 are g and t, respectively, according to the corresponding sequence (GPT gene) in the Entrez Human Genome Sequence Database.
ccccgccttcacccactgcctctgcctccctggggcagagctgtttcccagacgggtggggcggggcccaactgtcccagctccttcagccctttctgtccctcccagtgaggccagctgcggtgaagagggtgctctcttgcctggcgttccctctgcacggctgccccctcccaccctgcccactaagccagacccactgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccaggtatggcccagggcccctcgctgccctccaggtcacaatggggtggccgagttggccccagccccactggcacatgggacaagggctgaggggttaggtagggcacagtctccctgcctgcacccctcccagggtgtgaagaagcctttcaccgaggtcatccgtgccaacatcggggacgcacaggctatggggcagaggcccatcaccttcctgcgccaggtgaggcttctctgcactccctcccggagcacccccccacccccagcccatgtaccctggcctcagcactccgtctctcaggtcttggccctctgtgttaaccctgatcttctgagcagccccaacttccctgacgatgccaagaaaagggcggagcgcatcttgcaggcgtgtgggggccacagtctgggtgagagagagccagggccagggccaggcggaagcagagggccgcccttgccactggaggagggaagtcccttgggagggctgaggagaacttcacctgtaccttcccaatcctttcctgcccgactccaggggcctacagcgtcagctccggcatccagctgatccgggaggacgtggcgcggtacattgagaggcgtgacggaggcatccctgcggaccccaacaacgtcttcctgtccacaggggccagcgatgccatcgtggtaggctgggcatgggcaccaagacattcctgacactgcagagggggcgcccagggtgggggacaggtgcggccccaggccctcgccaaccctgccttccccttcctttccgcagacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccggtgcgttccccgccgccccgcccaattccccccgcgccaacgttgcgttccccgccgccccgcccaattccccccgcgcccacggtgcgttccccgccgccccgcccaactccccccgcgcccacggtgcgttccccgccgccccgccccactccccccgcgcccacggtgcgttccccgccgccccgccccactccctccgcgcccacggtgcgttccccgccgccccgccccactcctccccacccaacgtgcgccctggcccggcnngccggtccgctggaccccgctgcccagcggagggcagtgcgcccccttggctcacccagcactgctgcctccccggcaccccagggcaggtgcagacccgcgagtgcatcgaggccgtgatccgcttcgccttcgaagagcggctctttctgctggcggacgaggtcgcggcgggggagcggggagccgggcaacagtccgcccccgtgacgccttgcgccccttaccgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcaacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgtgagttgggggcaggagggggtccaggtgacctaatcaggggtgggggatccgagtgccgtgccctgatgggccctccctccgcggccacaggagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggtaggggggtttgggtatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctg

SEQ ID NO: 148 - DNA, 415 bp, Homo sapiens
  misc_feature (27)..(54): Each of the "n" positions at 27, 31 and 54 contains no nucleotide according to the corresponding sequence (MYL4 gene) in the Entrez Human Genome Sequence Database.
  misc_feature (94)..(343): Each n position in the sequence may contain no nucleotide, or represent at least one nucleotide selected from a, c, t or g.
acatttcccgcaacaaggagcagggcnaccntatgaggacttcgtggagggccntgcgtgtctttgacaaggagagcaatggcacggtcatggnnnnnnnnnnnnnnnnnnnnnnnnnnnnnnnnnnnnnnnnnnnnnnnnnnnnnnnnnnnnnnnnnnnnnnntgttagctgggcaagaggatnccaatggctgcatcaattatgaagcctttgtcaagcacatcatgtcagggtgaagcagagtcttccaggtgcctggcccttggctttagccataccagggtgagttaaagagaggccccggctggnnnnnnnnnnnnnnnnnnnnnnnnnnnnnnnnncaccactgccccaaggaccttacaggccctccctgttaataaacagctctaacacggccaggctgggctctg

SEQ ID NO: 149 - DNA, 1678 bp, Homo sapiens
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaaaaaaaaaaaaaaaaaaaaaa

SEQ ID NO: 150 - DNA, 607 bp, Homo sapiens
tgaattcgtgggtggcggcggcggcggacccttggggtctggacgcgacggcggcgggacgatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagaga

SEQ ID NO: 151 - DNA, 2160 bp, Homo sapiens
cgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcaaaaaaaaaaaaaaaaaa

SEQ ID NO: 152 - DNA, 1368 bp, Homo sapiens
atccacattcaagtgttacatcttggctgtgctaataggagctggagcctgtcccatatttttccctccccgtttcctttggggttaaaataaaatgattgaagttggttgtacactgccattgaattcaagaactttcataagaagtgtataacatcagctgtgaatgctgaaaagcttttcaagccacagtcacaatatgcctgccctcttagcagatgctggtagcggtagtctagcacaactggtactgtccctcacagagcttaggcttctggggagtattgtaccatgaacaccactgtcccagaaagtgcccgggccactaagaatcacaaaccctactgtcctcgccagtgctgtgcgtctttctttaggaggccctgagacagtttatttaacacagctgctactgtcttctgatatttgcatttgttcagcgagttgttgaaccacccagttattactaccccagtagttgctaccaaactttcatagcaacaaagggtattgttttggttagtgtaatataccagttcttctgcatgaatgtcattgaatatatttacgtatatataaaatatatgccatatggtaaattagctagggttgagaagtttgctcccttgaaatatagtttcattggcaagttataagcagcaagcaggagcatttaaaagtttatttaacaaatacttatattcactatgtgtcagggtttgttctaagtacttaaaactgttactcatttactcctaaaattcactttaaggatcctacttgaaacacaggggggttaagtcacgtacttaaggccacacaggtggtaaatagttgaattagattttgaaagcaggcagcttgactgcagagtctaatcactgcactgttgcttgtggaatctagcatgtttctcacagtttgggccctatttgtgtctttgtgtatgcaattttgccaaagaaaaaaattgcacctgttcaaacatatgatcaactccttgatttaccatgtggaggattacaactagattatatatttcaatattgctattgaaagacattgatagactgggtactgtggctcatgcctgtagtcccagcactttgggaggccaaggcgggtagatagcttgagtccaggagtttgagaccagcccaggcaacatgatgcaacccctcctctacaaaaaacacaaaaattagccaggtgtagtggtgcacacctgaagtcccagctatttgggaggcagatgtgggaggtttgctttatcctgggaggctgaggctgcagtgagccaagattgcaccacagcactccagcctgggcgacagagtgagatcctttctcaaaaaaaaaaaaaaaaaa

SEQ ID NO: 153 - DNA, 566 bp, Homo sapiens
  misc_feature (82)..(384): Each "n" position in the sequence may contain no nucleotide, or represent at least one nucleotide selected from a, c, g or t.
gatcttcgatcagtttttatagcatctatggacatagaaaatcagtcactgaaaaaaataaacacagctttcaatgtctcannnaaaaaaaaanannnnnnnnnnnnnnnnnnnnaaagacattgttaccattcgtcttgcaaatttaagacaactgaatgaaaagccaattttttgaaagaatgtggcatataattagatatacaactgaaacaggatatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcgtaccaaaatgttnnnnnnnnnnnnnnnnnnnnnnnnnnnnnnnnnnnnnnnnnnnnnttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagag

SEQ ID NO: 154 - DNA, 641 bp, Homo sapiens
aaaaaaaaaacaatacaaaaaaaagaaaggaagagactgtggaacggtgcagagccagaaggagtttgtgacttttcatcttcaaattgtccaaatgaggctctcatgtctagtgattattaccattactgcagaactctgtgtgccactgatgctctgtgcccacggagaacaggcacagctgccaaggggtgtgtgtgtgttggggaccggcacgtctcctgcttggtctcctgtcttgctcggtaggctgccattcccgcattaacagccaacaatgcctgaagcgtagccttcatggagagtccacacgtctaggcaggccagagatttgagttcttgagaataaagccactgggccaggaactcacctttcaaaccctggtagagcattaaaatttccttgcaagaccagccaatgaataatggtaatcaatcaaatacaaaataactttcaaatagcattgtgctttatagcacacaaagcccttatttaaccttcaagaaaaccctgaggagtgggttttcaaaattattatattagtatccctattatacaggtgaagacaccaagagtagaaagattaagtgacaagcctggggtagcacatagaaggcacatggctcagtaaatattgatg

SEQ ID NO: 155 - DNA, 2652 bp, Homo sapiens
tggatatgggactcctgtttgtggcctgcctctcttccgagtcttccagtgcagtccagataacgatctctgagagtctcttgagaccactgaagcaagaggcttcaaggtttgttctaggcttctctagttggcaggtcttccccgatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgcttctgcggccaagtggataagaggagcggcctgcaaccatgggacagggtgagccaagccagcgctcgacagggcttgctggactgtatgcagcccccgcagcatcacctgttttcattaaaggaagtgggatggatgccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgttttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctcgacccaagtgctcctaatggaggtggagtcctggggtcctgtgatctggtgccggtcagagcagtcaaggaggggaccgtggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctg

SEQ ID NO: 156 - DNA, 3202 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcgggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagc

SEQ ID NO: 157 - DNA, 931 bp, Homo sapiens
caggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcgcccagcaggggcacaggcctggcacctccctgccttgtgtcctgagccatagtgactcttttatctgtgtgtcttttgctaaatatgccctttttatattaataaaagatgatttggagttgtgctctc

SEQ ID NO: 158 - DNA, 641 bp, Homo sapiens
agctgggtgcgcagcagcgcgagctgcaggaggcgctgggcgctcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaagcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatcccgaaatagtgatc

SEQ ID NO: 159 - DNA, 2301 bp, Homo sapiens
gaattcaggactcaatggtgctcagaacccccacaatctattggctgtgcttggccccttttcccaacacacacattctgtctggtgggtggaagttaaacacgcggggaggaggaaaggaataggatagagagtggaatggggtcggtaggggtctcaaggactggctatcctgacagccttccccgcgttcaggttgaccaacatggcctgcagccagagggcacccacctgacccttaaagagaggacaagttgggtggagtctgtggctgacactctgtgcacaatccttacaacactggtgatggtgagaagggaaagacgacaagccaggggcatgatcccagcatgtgtgggaggagcttctaaattatccactagcacaagcccgtcagtggccccatgcataaatgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggtaagcgcccctaaaatccctttgggcacaacgtgtcctgaggggagaggcagcgcctgtagatgggacgggggcactaaccctcaggtttggggcttatgaatgtgagtatcgccatctaaggccagatatttggccaatctctgaatgttcctggtctctggagggatggagagagagaaaaaaaacaaacagctcctggagcagggagagcgctggcctcttcctctccggctccctccattgccctccggtttctccccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttgtaagttcttggggaatgggtgcgggtcaggggtggcaagaaggggtgactttcccccactggggaagtaatgggaggagactaaggagctcagggttgttttctgaagcgaaaatgcaggcagatgagcataggctgagcaggttcccagaaaagcaacaatgggagctggtctccagcatagaaaccagcagtccttcttggtggggggtccttctcctaggaagaaacctatatcccaaaggaccagaagtattcattcctgcatgactcccagacctccttctgcttctcagactctattccgacaccctccaacatggaggaaacgcaacagaaatccgtgagtggatgccgtctcccctaggcggggatggggagacctgtggtcagggctcccgggcagcacagccactgccggtccttcccctgcagaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcttggaaccccactggcttcgagggctgggggagagaaatactgctgccctctttttagcagtaaggcgctgacccaagagaactcaccttattcttcatttcgcctggtgaatcctctaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcttggccctgaaggtgccactccagtgcccaccagccttgtcctaataaaattaagttgtatcatttcatctgaccaggtgtcattctataatattatggggtggaaggtggtggtatggagcaaggggtaggtggaaagaagacttggagggccttcaaggtctattgggaactaggccactgaaatataagcaggtttggctgttctgggccgaaaag

SEQ ID NO: 160 - DNA, 1519 bp, Homo sapiens
  misc_feature (973)..(973): The "n" residue at position 973 is nucleotide c according to the corresponding sequence (DKK3 gene) in the Entrez Human Genome Sequence Database.
  misc_feature (1090)..(1502): Each "n" position in this sequence may either represent at least one nucleotide selected from a, g, t or c,  or contain no nucleotide.
cacacacagccctgctcggtttgattttctccacgtggttgatattgtcttcagttgctaaggttgcttttgctaaatttcatttatcatccccttggtacgttcagttgctggctaagttgattttgcaaatttcatttatcaaacctcggcctacgattacctaagtacgtttctgcaggttaactgtatctacgctcagtcatatccttcaaagttactaatgcaactgccaaagagggacagtgtcaatatcattgtcttcattagaaggacggctgccccacactgtgagaacactgctgttcctaacagtagtttacttttagagggatgtgagaattagtttgaccttaattccagatgtgcattagccctcaaaagaaaaatcccattctccttccttttggggagcacttttggtggcaccaaggctggtgtggggtagtggagagagcactgagcttagagtcacaaccagatgaactgctctggtcttactcagctgtgtgacttgggctgctctggtcttactctagctgtgtgacttgggcaagcagcttgcagtctctgagcctctgagactccctgatggacgaggagaacaatgaccccctccccaggctgtgctgagagagggaattgatcttggatatgaaaatgctgccctggcacagaggtaggagctgagcaacactgctggatgaataaacacatgtaatgcagggtgaacagaacatttcatctcgaacagctgaaggcacacgttacctatgcccatggaaagaactgcgtggaaaattcatttgttgcatttttgccaggttgatgtttgcaaagcagggcactctccccacatttccccaaaaccaatcagagggagactccacattgtttccatctcctcccctcaaacaattatcaaaccatgtagaacaaacggctgtctgccaactggtagaggcaaagcagncaataatctggaattccgatcaacaaaatggtatttgttctcatactatgataaagacatacttgagaccgcattatttatggggaaaagaagtttaattgactcacagttccacannnngtacaggaggtcatggctagggaggcctcaggaaacttagaatcatggtggaaggtgaagaggaagnatgcaccatcttcacatggcagagcaggagagagagagcaaagttggaagtgctacacacttttaaacaaccagatctcttgagaactcactcactatcacaagatagcaagggagaaatccacccccatggtccaatcatcttccaccaagcccctcttccaaccttgggtattacaattgaatcatgagatttgggtggggnnagaaaagcaaaccatatcagagattgaatcaataatccaaagcctttcagcaaagaaaagcctgcaaccagatgttttactagtgaattccacaaacatttaaaaaatataaatgccaatacttttcaagctcctnnaaaaaattgaaaagggc

SEQ ID NO: 161 - DNA, 3142 bp, Homo sapiens
tgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgatctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgcaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgtcatttctcttgtaacaatggctttaagctggaggggcccaataatgtggaatgcacaacttctggaagatggtcagctactccaccaacctgcaaaggcatagcatcacttcctactccagggttgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacaataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 162 - DNA, 3270 bp, Homo sapiens
ggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacactgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgaaaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgcgctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgt

SEQ ID NO: 163 - DNA, 5722 bp, Homo sapiens
ggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaaagatttaaacaggatggtggctggagccactggtccccgtggtcatcttgttctgtgacatgtggtgatggtgtgatcacaaggatccggctctgcaactctcccagcccccagatgaatgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcatcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcaccttgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttccgtaattactaggtagttttctaattctctcttttggaagtatgatttttttaaagtctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattccttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagaatattcagattgtgtagatatgctatttaaataatttatcaggaaatactgcctgtagagttagtatttctatttttatataatgtttgcacactgaattgaagaattgttggttttttcttttttttgttttttttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatattt

SEQ ID NO: 164 - DNA, 3343 bp, Homo sapiens
tcccagccggctgaggcgggcagggccgggcggggccgcgccacggagtccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcaccctccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgccgccttctacctgcaggactcgggctaagtccagctctccccctgcgcagccctccgcggcggacaggaacaccagccccagcgagtctggagaccaggactctgccttccaggcgtagggccagggctctggcaggtggccagggctccacggggggctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccattgtccccaggggcacacttcccccttgggatgggcacagcctgccccacccctccatgattccaagggccaagaggggcggggccaggatggcttttcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgt

SEQ ID NO: 165 - DNA, 466 bp, Homo sapiens
accactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatgctaatcaagatgaacaggtcgactttcaagaattcatatccctggtagccattgcgctgaaggctgcccattaccacacccacaaagagtaggtagctctctgaaggctttttacccagcaatgtcctcaatgagggtcttttctttccctcaccaaaacccagccttgcccgtggggagtaagagttaataaacacactcacgaaaagtt

SEQ ID NO: 166 - DNA, 1192 bp, Homo sapiens
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgcttggtttatatttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgaaaaaaaaaaaaaaaaaaaaaaagg

SEQ ID NO: 167 - DNA, 1008 bp, Homo sapiens
ctggagtgaggccctcggatcggccccgccggggtcggcccacggccctggcggagcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcaaccacctggcttggatcaacaccccccggaaagagggaggattggggcccctgaacatccccctgcttggtgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaagggcagacctgcccctccaaactccacaagtatgggaccctggaggggtagggcaagggccttctcaatgcctccacctagaagttgaattgtgaggcctcccccaagcccaacccaggcggacaaaaggcctagaggtaacaataaagtattagggaaaggaaaaaaaaaaaaaaaaaaaaaaaaaaaa

SEQ ID NO: 168 - DNA, 773 bp, Homo sapiens
  misc_feature (1)..(771): Each "n" position in this sequence may either represent at least one nucleotide selected from a, g, t or c,  or contain no nucleotide.
  misc_feature (78)..(78): The "n" residue at position 78 is nucleotide t according to the corresponding sequence (B7 gene) in the Entrez Human Genome Sequence Database.
ntnnnnnnnnttnnnttactctgtgtcagtaatctggttataagcaaaactagcaatctgcaggtagggcagttcatncatctgggcacttcgcagccgattgccatcagccttgagccagagcaggtgggtgaggtagttgagtggagacaggtctgtcaggtggttctcagaaatatccacatagcgcagatggatgtaggagcgcagcaagtagatgtctgtcaggtccctctctttaacctccagcttgacataagcatgagccagcccattgcctgtcttacagagcagagaaagcccttcccttcatcatgtcctccgtgaggggggtgggcagccattcctcaagggaactcttccccctcttttcttgtagtcctcccccctcctctgtctccttcttcggcctcttctttctcaagaatcatccnggncttggntcaagagtcttccttagatcaactttnatcttacttcccagaggccgnnnttcaanttggttaccagttatnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 169 - DNA, 1673 bp, Homo sapiens
ggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccaattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatcccc

SEQ ID NO: 170 - DNA, 969 bp, Homo sapiens
ggcgccgggagtcgcgggtgcggcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaattccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaa

SEQ ID NO: 171 - DNA, 1464 bp, Homo sapiens
ctccccgcgccgccccgcgcaggcgcccccgccccgccgtcgccgccgccgcagccaggagccgctgcaccatgccccgcatagatgcggacctcaagctcgacttcaaggacgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccacggcctgaagggccacatcatctctgatggaggctgtacgtgtccaggggatgtcgccaaagcctttggaactggagcagattttgtcatgctgggaggaatgttttcgggtcatacggagtgtgctggagaagtgattgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgatggaagcgtccaaacctgcttttcccatctccccccaagtctgttccgtcagagcttctggctgctcctgaatggtggaatgcctgtgtcctctcttctgtctcctgccgcctggaggcttcggggctctcccgcctgccttctcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcagctttaatataatgctattatctt

SEQ ID NO: 172 - DNA, 2665 bp, Homo sapiens
agaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtcg

SEQ ID NO: 173 - DNA, 307 bp, Homo sapiens
  misc_feature (48)..(282): Each "n" position in the sequence may contain no nucleotide, or represent at least one nucleotide selected from a, c, g or t.
  misc_feature (103)..(110): Each of the "n" positions at 103 and 110 contains no nucleotide according to the corresponding sequence (C4A) gene in the Entrez Human Genome Sequence Database.  The "n" position at 105 is nucleotide c according to the same corresponding sequence.
ctttccgcctctttgagaccaagatcacccaagtcctgcacttcaccnnnnnnnnnnnnnnnnnnnnnnnnnnnnnnnnnnnnnnnnnngttcgagcctcctngncgccnttcgcttggaacctgggaaagaatatttgnnnnnnnnnnnnnnnnnnnnnnnnnnnnnnnnnnnnnnnnnnnnnnnnnnnnnnnnnnnctcgaatagctggatcgaggagatgccctctgaacgcctgtgccggagcannnnnnnnnnnnnnnnnnnnnnnnnnnnnnnnnncttcctccaggagtatggcactcag

SEQ ID NO: 174 - DNA, 1230 bp, Homo sapiens
aagcttgtggcatttggtactggtatctgagcaggggctggctttctgtttgtctgtgtgttttttgcatgatcttggattgtcaccctgctgtatttaaacattaaaaagcctgtcttttcgttgaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattc

SEQ ID NO: 175 - DNA, 1314 bp, Homo sapiens
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcaatttgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 176 - DNA, 661 bp, Homo sapiens
ggagtggcagccggagtctgaactgtcctgggggaccaagcaggagcttaagatgggcaagacctggggccctgggcagacgcatcaaagcaggcagaagcaggcatggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgga

SEQ ID NO: 177 - DNA, 578 bp, Homo sapiens
  misc_feature (53)..(567): The "n" residues at positions 53, 123, 346, 447, 559 and 567 are nucleotide g according to the corresponding sequence (DPM2 gene) in the Entrez Human Genome Sequence Database.
aacacaccatcagtgtttattggtcagctgtcccaaacgggccagccctgggntttggggctgggctccgtgagagacggtcagtcggtcagcggcccggggtggctgccctgagccccaggntggtcctggggtctgtcagtccttccccaggctttccaggtccagaaggctttgtggggtctggggctgtgtcagggtaaggaaagctgccttggtggaggaagagaagtcagagaggtcacacatgttgccttagaacctgctaagtccaacgtcagcatgtgacaggaggggaagtgaggcaagacggcagaacccaggggaaaaggtggcagggagtctnagagtgaggttgggaggaccagcatcttttaggccctgagcaagaaggaggtgaccggagtcttccaggtatccctccctcctagcttctggaagtgggantccgggaaggggctccagtcagtcaggtgtaagctccatgccatgggactcttgcaagacaggcaagctttaagagcactgtgccttgacaggtcttcaagctccccaattngtcctgtnctggaagggaa

SEQ ID NO: 178 - DNA, 4181 bp, Homo sapiens
cctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagg

SEQ ID NO: 179 - DNA, 2141 bp, Homo sapiens
cgggcgaaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcacttaaggattaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcacttgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcagtgatccacccaccttggcctcccaaagatgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattgggcaaactttgtattaatgtgttaagtgcaggagacattggtattctgggcagcttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggtttttctatatggggattttctatttatgtaggtaatattgttctatttgtatatattgagataatttatttaatatactttaaataaaggtgactgggaattgtt

SEQ ID NO: 180 - DNA, 1613 bp, Homo sapiens
ggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggggctggcgctgcaaccggtgtacccgggggccggcgccggctcctcgggtggctacttcccggggaccgggctttcagtgcctgcggagtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacaggggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaaaaaaaaaaaaaaaaaaaaa

SEQ ID NO: 181 - DNA, 396 bp, Homo sapiens
  misc_feature (176)..(230): Each "n" position in the sequence may contain no nucleotide, or represent at least one nucleotide selected from a, c, g or t.
ctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctcnnnnnnnnnnnnnnnccccaaagtcaaggcacnnnnnnnnnnnnnnnnnnnnnnnttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgagg

SEQ ID NO: 182 - DNA, 1064 bp, Homo sapiens
  misc_feature (27)..(766): The "n" residue at position 766 is nucleotide g according to the corresponding sequence (GRO3 gene) in the Entrez Human Genome Sequence Database.  No residue exists at n position 27 according to the same corresponding sequence.
cacagccgggtcgcaggcacctccccngccagctctcccgcattctgcacagcttcccgacgcgtctgctgagccccatggcccacgccacgctctccgccgcccccagcaatccccggctcctgcgggtggcgctgctgctcctgctcctggtgggcagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaagggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtngggggattgaaatgcaagcaattagtggatcactgttagggtaagggaatgtatgtacacatctattttttatacttttttttttaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatg

SEQ ID NO: 183 - DNA, 14800 bp, Homo sapiens
cgcccgggcaggtggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcagggatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcgtggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacttggaggtggagcgctggcgggagcgggtcgcccaggtgcttgagcgctggcaggctgtgctggcccagaccgacttgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgagaccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaagagatcctggcgctgaaggcgagcttcgagaaggcggccgctggcaaggcggagctggagctggagctgggacgcatccgcagcaacgcggaggacacgctgcgcagcaaggagcaggccgagctggaggccgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccgagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctatgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaaaggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttttgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcgcccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 184 - DNA, 1982 bp, Homo sapiens
ggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttctcgtgccgaattcaaaaagctt

SEQ ID NO: 185 - DNA, 1641 bp, Homo sapiens
gattcccctcaccctctgcatcctcaaccccatccagtacctcgaagtcctcgagcggtgggaccccggcgggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcaaaaaaaaaaaaaaaaaaaaaggaattc

SEQ ID NO: 186 - DNA, 735 bp, Homo sapiens
gctgcccctgaaccccagaacaaccagctggatcagttctcacaggagctacaggccggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 187 - DNA, 1155 bp, Homo sapiens
atggattgcagtaacggatcggcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctgcattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagacgtagataatgggtgtcagcaggtcctgtggctctatggcagagaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttagctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctga

SEQ ID NO: 188 - DNA, 1447 bp, Homo sapiens
gaggcagcagcagcaggaggaggcagacacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataag

SEQ ID NO: 189 - DNA, 1895 bp, Homo sapiens
gctttccagccccaaccatgcataaaaggggttcgcggatctcggagagccacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggtgggtaccggcgccctggggtccccgggccggacgcggctggggtaggcacccagcgccgacagcctcgctcagtcagtgagtctcttcttccctaggagcgtccgtggccactgaactgcgctgccagtgcttgcagaccctgcagggaattcaccccaagaacatccaaagtgtgaacgtgaagtcccccggaccccactgcgcccaaaccgaagtcatgtaagtcccgccccgcgctgcctctgccaccgccggggtcccagaccctcctgctgccccaaccctgtccccagcccgacctcctgcctcacgagattcccttccctctgcagagccacactcaagaatgggcggaaagcttgcctcaatcctgcatcccccatagttaagaaaatcatcgaaaagatgctgaacaggtgagttatggtttccatgtacacaggcgactggagccgttggtcagaaatactggcatgtgccccctaaaaataaaatcaggaaaacccaggggttagttgaaggactagaaattgggattattgttttcacaattaaggtttcctttacgataattactgctctggtgccagaggatattcccaatgcctggcgtccccaccctggttcttccttcgttccaatgaatgtaggtaaaactgccttcatttgaggcccagtaggacaaacagcaacaggttctggctgtttttaatccaatagtacagtggagaccaccgccccaccccacccccattcctaaaagagcatcccaagcttagaggtccctgccacacagcacagctgtcataggcagtagccacttggttgccaggctggggaaactgcattcggagaactctagaggctggaggagcagggcaggagaagagtgttgtgcaatcagctttcccgagcacctactcagggcacccattttctcattgcagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 190 - DNA, 1604 bp, Homo sapiens
gacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgtggagtttgctgaacgacaagcgtgcagtggcggcacagcggcagcgctacgagcagtacagcgtggtggtggaggaggtaggccaccaaggccaggtctctgctgggccagggaaaccaggccagcccctgagccccccagacccatgcttatgccattgcaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaaaaaaaaaa

SEQ ID NO: 191 - DNA, 611 bp, Homo sapiens
acttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttc

SEQ ID NO: 192 - DNA, 8460 bp, Homo sapiens
  misc_feature (8148)..(8148): The "n" residue at position 8148 is nucleotide c according to the corresponding sequence (FASN gene) in the Entrez Human Genome Sequence Database.
cggccgtcgacacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcgctgtccccgaccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccggcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatccggaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgacccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcacttcccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcacccctcgggacatgtggccttcctcacctccactgagccgcagtatggccagggcatcctgagccaggacgcgtgggagagcctcttctccagggtgtccgtgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaacgctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggagggcccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccaggccatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctcggtgccgctgagcagtacacacccaaggccaagtaccatggcaacgtgatgctactgcgcgccaagacgggtggcgcctacggcgaggacctgggcgcggattacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgttcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagccngctgagtggggggtcgtgggccagtccccgaggagctgggcccctgcacaggcacacagggcccggccacacccagcggccccccgcacagccacccgtggggtgctgcccttatcgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctcccc

SEQ ID NO: 193 - DNA, 2595 bp, Homo sapiens
aatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacaggtcagtcctgctggttggtggatgctccttgattattctggaaggagctggtatgcttaatttccaaggaaattaataatgatcttttttttaaaaggcttttgtatcagactagtgttgtagtgcatggagagggtgcccagaggtgttggggcaaagaagtctcagggattggtgtgttttcaaggattttatacatttgggaaataggaagtatgtgggggtggttattgtgacggtagtgttctgttaatatcttgaggctccattaatcaccggtctgaccatgctaatggtttacatcaggttaacactttacacctcatcactcaccctccacagcccgatttgtgctgagttcttgatcttttctttacctgagtgttgccatgaagcgtgtggggaatctcaagtcgatttaaaaatttttacatttccgtctcatggcttcccactttgccccaggggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatgttctcatcttttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactc

SEQ ID NO: 194 - DNA, 87869 bp, Homo sapiens
aagctttgtttagtttgctgtcagctctgcctcagcctacccagggcgctggcatcccagagctgttgtggctcaccccccggtgggtaccacaatacctgcctcatccctctacaccagccgccacatccaccacacacacctccacacaccacacctccacccatagacctacacacacaccacacacacatctacacccaccacacacacctccacacacacctacactcatacacctacacagacacccctacacacacaccacacctacacactcatgcacctacacacacccctacacacaccacacacacatctacacccaccacacacacctccacacgtcatacctccactcatacacctacacacacccctacacacaccacacctacacactcatacacctacacacccccacaccacacacacatctacacccaccacacacacctccacacaccacacctccactcatacacctacacacagccctacacacaccacacctacacacccatacaccacacacacccacacacaccacacacacacatctacacccaccacacacacctccacacaccacacctacacacaccacacctccactcatacgcctacacacacacccctacacacaccacacacacatctacacccaccacacacacctccacacacctccactcatacacctacacacacagccctacacaccacacctacacacccatacacctacacacccccacacacacaccacacacatctacacccaccacacacctccacacacacctccactcataaacctacacacacagccctacacacaccacacacacatatctacacccaccacacacacctacacacacacattcatacacctacacacacccctacacacatcacacctacacactcatacacctacacacaccacacacacatctacacccaccacacacacctacacacaccacacctacactcatacacctacacacacccctacacacaccacacacacatctacacccacacctacacacaccacacctatactcatacacctacacacacccttacacacaccacacctacacactcatacacctacacacacaccacacacacatctacacccaccacacctacacacacacccctacacctacacatacacacctacacacaccacacacctacacctacccacacctacacctacacatacacacctacattcatacacctacatacacacccctgcatataccacccctacacactcatacacctacacacctgcacacacacccctacacacaccacacacatctacacacaccacctacacacaccacatacatctatacctacacaacctacacctacacatacaaacctacactcatacacctacacacacacctacactcatacacctacatacacacccttacacacctacacacacccctacacacacacgcctcccaaagtggcagcaggcctcctgacccgaaaggcgcacccctgttagaagccgcgccctccagtggccctggcgctgccgtccctccgccatcagcgtgactctctctcacccagatgggaggcggctgcgggaaaagcctcagtgactggatggtgagacaaggcatggtgagcaggggccaggcccggccacccggaaagctgggggtgctcgcagggctcctgccaggcatgggcgtggggcaccgtgctgctctccaagggagtgggacccaggagaaggcccagaggagcaaggaggggcagctgagggtcttgcgggaccccagggctcaggctgtttccgggttggcccggccagcccagcttccgcagctcctctgtgcccggttcctgctcttgagtctcgggcaaggacaaggtagcccgtctggcagctaagaggcgatggggatagcggagcgggagacggagccggtgtgcacagctgggcacttgctgttgccactgctgctgggaagtcggctcctgccttctctctgggctctgctcctgcctggggggtcctcaggtgctgggtgacagagcttggaaaccaaactggcctggttggggaaagactctgtctgtcttttccaaagtagctcactagtaactagtgctattagtgccattactgattaatagtaaataggaactggcctattggtttcttgagcatctcctccatgccaggccctgtgctaagcttttgacatcccatttcatcctcacagccacctggacggtaagtactgctgctagcctcaccctaaggacgagggaaatcaggcgcagagaagttaagtaacccactcagagtcacactgtgttaaggggtgagctaggtccagctctttctcactctgaagtctgtgcccatgacctccaactggagtctgcccctgcagaagccgttagagaggaaagcctccaactcctgcccctgtgtgggagccatcgtggcacagcccatgtctttgtggccgaaagtgaaatgtccccatctgtagcaccgcccctctgggtctacccacctggccttgtctggttaacttcgcgcctctgctctcaggccctgctatgcccccttctatcatgaaatctgcgtctgcagagacaccaggggatggaacctggggacccctggcccactaaccatgtccccatcccagccttcacggctggagaaaatgcctggggtctgaccctgggcttggcgtgtcttttgtcagatgctcctgagcacctgcagcatagcccctgccccaggccattgcccaaagcccctcctccagcctagaatcctacccgaagggtgtgtcggaactggggttcttctcttcaaggggaaggagctccctctgacccctggccctgctccagctgctgggagcctggtcccctgcttagtctcctggctctgcacctccatcacccacagcctggcacagcgggcccagtggtgggtccgggcagctaggcagctgaggctggggtgggaggctgcccagggccacccagctgcagggtgctgagctggcacgtcttccaccttgtcacctagggcactgccttaccctctgcccttccttccagatcccagtcacccaggcctgcctcatggaggacatcgagcagtggctgtccactgacgtggtatgttggggcccactcctcacccacacagcaggaggacccgttgttctcaccaagaaatgacccatggggccagggtagacttatatagcatatagcaccctgagagcagaggggcacacttaaagtccccatctcctgccacctgcccaccttgtgtttggcacgccccccagagaagtcctgggcacagtagcctctcggctgcttcccagagcctgctcccaaggtgaggtcccagtgggtgtcagcccaccttagggacatcaggccaggctagagaggctaaccgaggaagcataacagcgccaggctcttacctgcagtagctcagaagactccagccacttgcagagggaacccatcaccaccctgtttacagatcagaagaccgataagcagctgtcctctaaggggaagcacccaggaggaggagggcgggtgccagtcatggggaccccaagccctgccaccctcccagggagcagaaggggcagggccagactcagcttctccgtccagggctcctaccgcagcatctgccaccccgtctctgggcaccaaggcccacatgggcacttcaggcccagaagccgccttctgcaggtgaagagaccatttctgcccaggactaagccacagaccaaggactcaggctttctgtctggtggcagaagcctcaccccctccctagtttgcagtgttagcatgaatggccctcagcctctggatgtcagcctttcccccccaggggtgaggaccacccaccccttgtgaccctccaaggaaaggaaccagcactcatcaaggtcccactgggcaccaggtgctgggcttggcgtgctgtgtgttatcccatttcagcttcccagcaaccctccaagttagcttcagcccccaccccgcccccattttacagaaggaaaacacaaggctcaggaagtcaggtgccacccaaggaaggtcctacggctcagggaggagcccaggtccaggtcctgggacctgggtggtgggggcgtgcagagcctgagctgggacccagtgctgaggttcagcggggcccgagctgcagcaccactgccccaggctgaccgtactgggggcccggctaacctctgcctcctttccttctaccttcccagggtaatgatgcggaagagcctaagggggtcaccagcgaaggtagtagtccccgcccctgcccgccctctcctttccccagggctctggcctcagggcctaccctcaccctctccccttcctctagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaagtctcctggtcagaaatgacttcttggcctcacagaggcagcgactactttgggcagggctgggggccatccgagaggtgagcatctgtagatggtgcaggcggaaggacaggagcaaacacccagctacactacgcaggtgccgcctcctcccacctcacatggcaggctccagccaccgcccctgcccggaggatgcatgccctccccagctgacacccctccctcctcaaggcaccttcgtgctgctgttccatgaggccagctcctgccctgcacagagcacactaatcacaagggcggggacctgtgtggactgtgtgcgcatgtggggtgcacaggccacaggaggatgctggccttccgaggctgggtgccaggcacagcctggggctacgcactggctcgtagcatcacaacagcctgggagaagcaaagtgagcgtcctcgatgtatagatgcggagactaggactccatgagccgcccagctcagaggaggaagctcatgcagttgtcatgtgccagcatttcctcatgcagaagcgcatcctccccattttccaggcaccaaagctaagttgggaagacatggcacacagttccagacgctgggccccaggtcaggtgcagggggtcagctcttccctccatggcagctcaagagccccaggtcttagggtgccaccttttcaggtgtgggatctctaggccagactccctgggagtcactgctgaggcatgttggagcctcctggcccaggacacggtcggggaacggtgtgaggccaaagcaattgggtccacagggtcctgggctcctgggagagggccgaggtctgtgtgagcagccactgattcccatgggcagtgggcaggcagcacctgccatctgaggtatggtctggagctgggcatacaggagaccaggcccagcccagccctcaagatggagttggggcaaggaaagcagctgggggcaggcacactggtgccaggcaggggagggggaggccctgccgccatcaggatgctcatggtccaggccaagctccctctgccacatccagggcatctgtgagctcctgccaggtgccctaccctggcccagccctttcagtacctcacaacagccccagggggtcaatggtgttggccaccagttacaaatggggaaactgaggctgagggaggaagggacttgcctggtcatacactaagtaatggaagactgggacccccaaccttcctcactgctgcctcacctgcctgccccacccacaccccactgcctgcttccctcattctctccctacttaactggggacctcttagaggggagttgtgattttacaaggatcaaagccaaggcctcctctcccctgtgttagctgggaaacccaaggaaacttccacagaaggcccccagggctgggagggcctcaggtgctaagggtgaaaactgccaggttgttcattcctccctgtgggtgcatcccctgggagccagctgcacacagcatagcgctaggtgcccgccagacagaagtgaagcggccaggtgccagccctgtggggtcacgtgggagggaaagggacgagaaagacagacataaactcaatcattgtttcacgctgtgaaaagaagaagatgggacgggacgcccagggccaggaggctctctgtgaggacggcctaaggctgctgaggtaagatggggtgggctgggccatgaagggccttgaatgccaggcaggaggtggcccctgcagaggtctcggcttggctggctggaacagttccaggctgcctgaaggcctccttcagagagaaggctgctggggctgcatgggggctgggggggggggcgctggcgggaattcatcagtgcagtcaggctgggttccctggcagcaggctctgtctgaggctgcaggcctgggcgggatcactttacagctgcaggaagtcttggccccaagaaaatgagggccagctgtctggtgggagccttgggtaggagcagggcctccacctggcaccacagggcaggattaacgaggtgccgccgctcccgctgggcccagctacatcggaaggcgctgggccgggggcatggaggggaggggttgagtggagctgggaggggctggtgggcaggggaaagggcgcctggggggcagccccaggcctgcctttgaggaagccttttgcagagcctccaccaagccctctccctcctggctcccctgggccaccacgatcccaccctgggcctggacaccgacccctccacctcctgccctagtgtcagtacccacctcccagaccggccacttctgggctgtgtgaccttaggcaaattacttaacctttctgtgcttctgttttctcactggtaaaatgggcagataacactcgttgcctcatagggttgttagggttgactgagccaacaagtaactcagcacctgccatgtagacaatgctctgtacatgttgttattgtcacggatggttccctgctcccttccagaatggcctctgctccagacacctggctcagagccctgcccctcagactcctcagtaattctagggacccctgctctgcctctggtattgccttcccagctccagaataacgtctgtccctactccccactgggagagaaccaaaggactgtgtctgtctttcctcctggtctgggctgctaaccctaagagggtcagggctgtcttgatcctggcaacacggcagggtccccctggcgttcctggattgggctctgcgggctctcggtaggcgctttaggaagcctttgcccgctccaaggtggctggaggtaggcccagttctgagtcctgagcacggtctacggcccctgctcagggtcagtgtttcaaggcgaccacgagatggcagtagcactgcatgtacagggcttgccggggcactagggtggagtccaccgcggccaaatcagcccctcccgggtacagacaccgggagaaaggggcgggtgctgccggctcctgcccgctcctgccccgcgcgagctcacaggcgcgcgcgtgcacacacacacgcgcacacgccctctgactggtggggctgagtaacaatggtgatggggctgggagctggagtccgagggtctggcttcaccgccgggctctgctgtgggactacacaagggatttcatctctggaagcctcagatcttcttaaacgtcccgattcacagggttgtggggaggatttggtgagacaagctgggagctcagctacgggagctttgggtgggcaaaagtgagcccggtcccctccctctctttacagagccccggtgtgccgttgctggggccccctgctcccgcgccttctcagccgacacgctcagatccgtgtgcattgccgtttctgtctccacgtgtagacaaatcatgagctcgcccagtaactccagctctaccacagattccttctcttttccgcccttcccctatgtctaattcccttctccagcagtgagaaacctgcttcccgccgtccttcattccttctctccccccatccccgcagaaaccaatctctgttgccaccactgccccgtcctgccagtgcctcccaccctctccgcgtggaccgccaccaccctgccccacagacaggcccctagacacagaaatcttctttctcacagttctagaggctgaagttcaacatcaaggacgtggactccatctgttcagttggttccttccggcccctccgtggctgtatatggtcatcttctccctggggcctcacatcatatcccctctgcatctctctatgttcaaaagtcccatttttataaggacagcattcatcaaggattagagtccacctaatgatctattgtacctattgtaccttaatcactttttttttttttttttttgagacagagtttcactcttgttgcccaggctggagtgcaatggcgcgatctcggcttactgcaacctccgcctcccagttcaagcaattatcctgcctcagcctcctgagtagctgagattacaggcatgcgccatcacacctggctaattttgtatttttagtagagacgggttttctccatgttggccaggctggtctcgaactcccaacctcgtgtgattcacccgcctcggcctcccaaagtgctgggattacaggtgtgagccacagtgcctggcacttctttaaaggtcctacctccaaatacaatcgcattctgatatactagggattagagattcaacgtatgaattcaaagggacgaagcagccctgtattgccctctgctgccctctaggccctgggtccattctcccagacacactgctctttcgcaggtggccacagtgtcttcagaggggctgccacatgaaacacccgcctccactccctgccccctgccccctgccctagtgggagtttgagggtggctagattcatcctagggcagcctagccttagatccaaggattagccatgggaccaggagcgagcaggggtgccggcagagtggagggagatacaggtgctgggagctgggctggggctgctctcctggtccccatgtccgcttgttttttcagagcagacccaagcgggtaagctggcaggtttcacttccacccaccctggtacagggcgagactggaggaagcagcttcgccgggccgaatcctcaccccttgcctctgactcaggactcccgtgacgtcttcctgcccctgctgcaggctggccctgcaccctctgtgcaccgtggaccaggctggccagcagagggaaggaacccaagctgaccagggccccaaatccccagtgggtcagagtcaggttggcagggcacttggacctcttgaggcgggtgagaaatgtgcagacagggaagtggaggcccagggaggggaggggcctgccctgaccagtgtactgcctccctacctggtgcaggggcccaggaggctctgtgtgccagcccagcctgcccggggaggaagcagcccccacccacgcacaagcacagggaagtcagtgcagggtggagggtggggactcctggggccccctgtgtcaggtccaagcacggcccaggagtcagccaaccgagcttccagcggtgcacagacactgacttcctgtttgatttggagcaagccttctcctctctctgggcctcagtttccccatctgttaatcggcttgatttaagagagcgtaaggcccctttgcactctgcttttctgccctatcaacccccaaattccataatcctccttccaaaaaggaaagaaatacgaggaaagaaactcaaatatctacaagagagggaagcaggaccccgggtttatctcccctccaggaccagcggcgatagggaaacaactgcccaagcttcagtgggaccaatgggtggaggcggccacccacacaccctgctgaatgcccgcacaggaagctgaccgcctaggggcaggagggaagcgaaacccaagccggggacatccttgcacctgccctggggtacccctaggaaagggaaaagcaagtgggtgaactgaggaatgggggtgctgcccatgctccccacaggaccctgccctcactggagcccttggaagctctgttaaaaatgaatcttcagccaggcgcagtggctcacgcctgtaatcgcagcactttgggaggccgaggtgggtggatcacccgaggtcaggagttcaagaccagcctggctaacatggcgaaaccctgtctctactaaaaatgcaaaaattagccaggcgtggttgtgggtgtctgtaatcccagctaccagggaggctgaggcagaagaatcgcttgaacccgggaggcggaggctgcagtgagccgaaatcgcgccactgtactccagcctgggcaacaagagtgagactccatctcaaaaaatatacaaattaaaaaaaaaaaaaagaatcttcattttacaaaggagggggtgaggtcagaaaagtcaactagctaatccaaagccacacagccggcaagtggaaacattgagtcctcttttctggggagaaaaggtccctgggggatcaggatgaagtgcactctattctgggcctggggctgcgcctaggtctgccttggggctagaaaagtcactgtgtacattatctgtatgagtagccctgagccctgcaagccacttaggctgcagaggccactggacccctgcagggagaaggctggctgctgagatggggccctccctcaggatcccttctcaggcccagaccagtgcagagacttgcccaaggccacacagcaaatttgtaaaagaactgaaactagaatcccggtcctccatagcacctgccccgcaggaggtgggcgaatggaggacagctgggaagtctgtcttcagaaggccctccccagcaccctgcaccgtgctctgggctcccacagaactttcagcctcagagaccaactaggccagtgggttctaaaaccttctctccccaaggaaatcttctatcatggtctctccccaagactatggatttagaagagttttgtttgttttgatttttggccacaaaacattccacaatgcattgagttgttaatatttttcccttttgggcatcagtaatcaagacttttttttttttttttttttgagacagagtcccgctgtgtcccccaggctggagtgcagtggcgcaatatcggcttactgcaacctccgcctcccgggttcaagtgattctcctgcctcagcctcccaagtagctgggattacagacacatgccaccacgcctggctaatttttgtatttttagtagagatggggtctcaccatgttggctaggctggtctcgagctcctgacctcaagtgatccacccacctcgacctcccaaagtgctgggattacaggtgcgaggcactgcgcccggcagtaatcagacttttaatacaccaatgcagtatctcgttccatccaaaagtgctccagttgcctgggcagcctcatctgagggaactaacagcacagcctctgtttgcccagcccctctgggcccacccactgtttggagcagaaccccaacccaaaagggcaggagctgaagatagccatgctcactgctggccaggggctcccccacggctcctgccagccttggccttcacacgcattgggcatctccatcgacggccaccctggcttctgcaccgtccccacgtaaacatggctctgccctcccatcccctcacctcaactctgcaacacagggacccaggagacagaggcaaggaagggagagtgaaggagctggccataccctcctgaagtgctaaggggagggaggaggggatatcaaattcgatgtgagattaaacttcaagactggacttttttttttttttttgagatgggatctcattctgtcacccacgctggagtgtagtggcgctatttcggctcactgcagcctctgcctcctgggttcaagtgattctcctgcctcagccacccaagtagctgggattacaggcgtgtgccactatgtctggctaatttttgtgtttgtagcagagatagggtttcatcatgttggccaggctggtctgaaactcctgagctcaagcaatccacccacctcggcctcccaaagtgctgggattacatgtgtgagccactgcgccaagattggacttttttgtacttgaaaatgacaagaaagttagcaaaaccacccaagatgtcacaaaggaccctggtggaggctgggcatggttgaagacaatggttggagaaaaggaagctctctcatgtccatgtttgtgcacagggactttggatctgcaagcttggggagggagctggagacagctggactgctctgctcttaagagggaggtgaatcctaccgggccatctggaagagggcctgagagcacagagacaagaacggggaaagggaagagagagaaggcaggagagggtgagctactgggccccaggcaaagagttgggggaggatcagaggtcaactactggggtagagggagggaagggagaggagtagccaaaaaagattcggaagaacagatgctgtattagattgttctctaggttctgtctaatgtcacccctctctgtggccctgagatctttagtaaatgctctgctcataagtatttgtcaagagtagggttttgggccaggcatggtgactcacccctgtaatcccagcactttgggcggcagagacggatggatcacctgaggtcaggagttcgagactagcctggccaacatggtgaaacctcatctctactaaaaatacaaaaaattagccagacgtggaggcgggcgcatgtaatcccagctacttgggaggctgagacaagagaattgcccaaacccgggaggtggagttgcagtgagcagagatggcgccattgcaccccagcctgggcgacagagtgagactccgtctcaaaaaaaataaaaaaagagtagggttttggggaactggggaaggagcaagtttcatgtctgagtcagcacagttcagagcagaaataggaagaagctgggacagcagggtgggggaagtggtgaaaacacaagtaccagggattgccggaaccttcaggaggactttgggcttttactggacgtgaagttaggggaggactctgcccttccctcagtgacttcttcacatgctgccaaatacatttcatttttttttttaaagaaatggggtcgtgctctgttgcccagattggaatgccgcggcatgattgcagctcactgcaacctcggcttcccccgtcccctctcccctaccccctgctcaagcggtcctcccacccagcctcctgagtacctaggactacaggcacataccaccacgcccagctaatttttatttttatttatttattttatttattattatttttttagagggagtcttgctctgtcacccaggctggagtgcagtggtgtgatctcggctcactgcaacctccacttcccgggttcaagcagttctcctgtctcagcctcccgagtagctgggactacaggcgcgtgccaccacacccagctaatttttgtatttttagtagagacagggtttcaccatattgaggtcaggatggtctcgaagtcctgacctcaggtgatccacctgcctcggcctcccaaagtgttgggattacaggcgtgacccaccacgcccagctgtcatttttttaaaaaatatttttgcagagatggggtctcactgtgttgcccaggctggtctccaactcctgggttcaagtggtcctcccacctcagcctcccgaagtgctggaattacaggcatgagccactgcacccagccgaaaatatatttcaaagggcaaatccgaccatgttttacaatacccacacccccaaaacccaacacacacacctaaaacctttcacttgctctcaggctaaagacccacctcctggcctggcctccagggcccctggagtctgtcccctgccacattcttcaggttctctgcactccagacaggctgtctttcccacctcaaaagtttcatgctgggctgggcacagtggctcacgcctgtaattccagcattttgggagcctgaggcatgtggatcacgaggtcaggagatcgagaccagcctggccaacatggtaaaatcctatctctattaaaaatacaaaaattagtagggcgtggtagtgcatgcctgtaatcccagctactcgggaggctgaggcaggagaatcacttgaacctgggaggtggatgttgcactgagctgagatcgcaccactgtactccagcctgggcgacagagtgagactccatctcaaaaaaaaaaaaaaaaagtttcatgccctgaccacagggcctttgtatgtgctatttcctctaaaacaggccacctgacttaactcattcatccttcagggctcagctactgtgtcacctcctcagacaagctactctaacttcctgactggtcattcatccggcacaatggaatccacctgcacaattacgctggcaaagaggaatgggatgaccacaggatggcttagaatctctgcctcagagtaaccatgactcacctctggcactgggcacaccctccctaaatctatgattccatctggatcccaaacaaattggggttctgttacctaggggaagaggagatggctgttgagtagacaatcaacagtgtccaccacattgccatacactgcactccccaacccaacctcacttgcagaggaggaagggggctcgtagacgtttctggaaggtgatggcaggagcacgagtgagaaggaagttgccctgcctgggcactggtctcagactggcctgacaagatgggaggttgtgtgatgtatgatgaagcctcactattggacagtttgtttttgatacaggtaactgccagtcatatcatgacctctgggacacacacatactaaaaaaaaaaaaaaatacacaggaaaacctcccagcttagttagcaatatgtaaggctttttgtctccccctccaacaaaaacctcataaagactcacgtagagtcagactgatggtgctgtttcagccaacccgtatcccatgcttgcatacctccagtgacagggcactcaccaccttcaataggagccatctcacctggccagccccccgacactgatccataaattaagctataaaatctagttggcatattgtttaatgggtacagaggtttagtctgggatgatggaaaagttctggagatggatggtggtgatggttgtacagtgggaatgtacttaatgccactgaactttacacttagaagtggtcaaaatgggccaggcgtgatagcttactcctgtaatcccagcactttgggaggctgaggcaggtgggtcacctgaggtcaggagtttgagaccagcctggccaacatggcgaaacactgtctctactaaaaatacaaaaaattagctggtcatggtggtgcgtgcctgtagtcccagctactcaggaggctgaggcaggagaatcacttgaacccgggaggtggaggttgcagtgagctgagatcatgccattgcactccagcctgggtgacaagagcgaaactccgtctcaaaaaaaaaagaagtgatcaaaatggtaaatgttatgtatattttactacaattaatttaaaaaaccacacacacacaagcaccatctctcaggcttcacaacttaccagctgtgtggttttgagcaggttacttttttaaaaatctgattggcagttaaggcaaacacttaggcccactctctcctttgatcccgatttgctttggttcagcctcatctcccaagctcagaaatttgggctccatttttagagcttcaaatcctgcctcttttctctgtagaggctgtagccgcggtcatcctcgcttgctaggggcctactgtgtgctaggctctgaggatgtacgtagcgagaaatgagtcatagcccttgtcctcccagccacagggaatagtcaggggaaaaggggttagttagttggatagataggtaggtaggtagggaggtagtggaaacctgccagactccagtctccatgaaccccagcccagctgtgaaactcctgaggactggtccctgatgtcctgtgtccccagatgccctcatttaggtgggaatgaccacagcacaggatgacactggtccctgagctcttggcatgaacagaatgtgtgtggggagcctgtgacctaggaatgtccacagcacaggatgacactggtccctgagctcttggcatgaacagaatgtgtgtggggagcctgtgacctgggaatgtccactgacaccggtgatcatgtgtccaggaagaggaggcaggaattctcatctctgaggctcactctgccccgggaattgcagaggaaccaagcaatctgggatcggagaacccagctaacccagagcagtcaaagtggtggccccagggccatgtcaggtcttgtggagggtggttgttgttttttgttttttttgttttgttttgttttgttttgagacagagtctcgctctgtcacccaggctggagtgcagtggcctgatctccgctcactgcaagctctgcctcccgcgttcacgccattctcctgcctcagcctcccgagtagctgagactacaggcgcccaccaccacgcctggctagttttttgtatttttagtagagacggggtttcaccgtgttagccaggctggtctcgatcatctgacctcgtgatctgcccccctcagcctcccaaagtgctgggattacagccgtgagccaccgtgcccagctctttttttctttttttaactgagtctattgtcaatgtttaaaaaactgaacatttcttttttttttttttccttgagacagagtctcacgctgtcacccaggctggagtgcagtggcacaatctcgcctcactgcagcctctgcctcccaggttcaagcaattctcctgcctcagcctcctgagtagctgggacgacaggcacctgccatcacgccctgctaatttttgtatttttagtagagatggggttttgccacgttggtcaggctagtcttacactcctgacctcaggtgatccgcctgcctcgacctcccaaagtgctgggattacaggcatgagccatcgcgcccggccacaagtgcatttttgttacatggatatattgcctgggcttttagtttaaccttcacccaaataacgtaaattgtaccctgtaggtaattcctcatccctcaatcccctcccacccaattattattcatttttcgagacaggggtcttgctttgttgtccaggctggtctccaactcctgacctcaaacaatcctcctgcctcagcctcccaagaaatagctgggatttcaggcatgagccaccatgcccagctgtggttactgatttttcagcaagagtcagccctctccttgaaaagagaagaagagtccccagctgaacacctgttgtgtaccacacactgggtacacgaagctcctacacccctgatctcagctggccctggtaagccgggattattagtcccattttcctgataaagaaatggagattttgcagggtgaagaggtcacaatatgggttaagtacagagtccagcacccagctccgtctgatgccaaaggccaggggctttccaccacgcccccatgccaccttcccaggggatgccgcctcgccagaagtccagggcacattctggaatttcttcagagaggaccttggaccctcatagagatcctttctcacagctgcctgctggggagcccttgagaagcaaacacttcccagcattggacaggtgacacagtgggtccacagacactgtcacaggtggccctcatgatggtcaagagccaattttttgttttttgtgtttcttggggttttttttttttttttttgagacggagtctcactctgtcacccacgctggagtgtaatagcataatcttggctctctgcaacctctgcctcccaggttcaagtgattctcctgcctcagcctcccaagtagttgggactacaggtgcatgccatcacacttggctaatttttgtatttttagatcccggcactttgggaggctgaggtgggcagatcctctgagtgcaggagttggagatcaccctggccaacatggtgaaactctgtctctactaaaaatacaaaaattagctgggcgtgatggcgggcacctgtaatcccagctactcaggaggctgaggtaggagaatcacatgaacccccgaggcagaggctactgtgaactgagattgcgccactgcactccaacctgggtgacagagcgagactccatttcaaaaaaaaaaaaaaagttatacttacaattattgacaaataaaagtgccctggctctgctacctgcctccttccctgttccccaaagtgaatgggcagagtgaggtagtggaggtggggaagagagggacaggcccagagcttgaacttgagccaagccccacaaaggaggaaagacatggatatcccaggcctctctgaggagcacaggactcaggacactgggttatataactgcaggggcgccgtccacactcggaccatgtgaatgggccctggctgggcagtgcagagcctgcatggtgctccaggtgacaggtggcccagcagggcgggatggatctatcctaagggtaccgtagcacccccttccttgttatgcaggtgtggaaactgaagtcagagagaaaggggacttgccaatggtgtgagcgtgagtggcagaggtgggaccacaacccacgtctcctgccctgccaatttccactgcggggaacagaaggggctctgtcccagatggagtactcggctgagcctctgtttcctcctctaaattggagctaattaaaattggctcttaggctgggtgcagggtgaagtcatcatgagacagggagatgaagaagcagtattctcatgctgacatcgtttctctgtgaagatcttctaacttggcataagctattttgctggaatttgggatctgaaaaacatcttaattcttttttattttattttttattttttgagatactcactgtctcacactgtatctctggctggagtgcagtggtgcaatcttggctcactgcagccttgaccttcctgagccgaggtgatcctcctgcatcagcctccctagtagctgagactacaggcaggcaccaccatacccagctaatttttgtactttttgtagagtcagggtttcaccacatagcccaggctgatctcaaactcctgggatcaagtgatctgcctgccttggccttccaaagtactgggattacaggcgtgagccactgcattgagccatcttaagcaatttgtttctgtttgtttaagacagagtctcgctctgttgcccaggctggagtgcagtgatgtgatctcggctcactgcagcctgaatttcctgggctcaagtgatcctcccaccacagtctcctgagtagctgccaccacaggtgtgccacagtgcctggctaagtttttaattgttttgtagagaccaggtttcgccatcttacccaggctggtctccgactcctgggctcgagcaatctgcctgcctcgggctctcaaagtgctgggattacaagcatgagcttctgcacctggccttaagcaattcttttttttttttttttttttttttttttgagacggagtttcgcttttgttgctcaggctggagtgcaatggtgcgatctcagctcaccgcaacctctgcctcccgggttcaagtgattctcctgcctcagcctcccgagtagtgggattacaggcatgcgccaccatgcccagctaattttgtatttttagtagagacggatttctccatgttggccagactggtctcgaactccccacctcaggtgatccgcgcgccttggcctcccaaaatgctaggattacaggcctgagccactgcgcctggccattaagcaattcttaatcaaaaagccttatgattccagtgtcagcgatcctaataggaacagtggagatgcaaacagccagtatccagtgctacgtgactttcggttacgaggaagtgggtcaaagagcagcctgattaattataacgatatttctgtccagaatctttgttaacactatgaggacagcttcagttcttcttaaccctgtgaagacagcttcactgttattattcctattttacagataagaaaactgaggccccagagacattgaaagacttgctcaggtcacacagcccgttattaatgagattcaaaaccaggtctagggatgtttttagccaccaggccttataagaaaggaactgtatcatttctatcaatagatcccagccaggtgtggtggctcatgcctgtcatcccagcactttgggaggccgaggtgggtggatcatctgaggtcaggagtttgagaccagcctggcctacatgatgaaacctcttctctactaaaaatacaaaaattagctgggtgtggtggcaggagcctataatcacagccacttgggaggctgaggcaggagaatctattgaacctgggaggtggaagttgcagtgagcagagatcgtgccactgcactccagcctgggtgacaagagcgaaactctgtctcaaaaaaaaaaaaagatcccatttccctttgtttagcaagggtctcccgctgtacacaaaggcacttctcctttactacataaacagtgagtcatgaatccaagcaaataatctagtgtctgggaacgttatgtcatgcctgtaatcctagcactttgtgaggccaaggcaggcagatcacttgagcccaggagttcaagatgagccatggcaacatagtgagacaccgtcgctacaaaaattacaaaaattagccaggcatggtggtgcgtgcctgtagtcctagctactcaggaggctgaggtgggaggatcacctgagcccaggaagtggaggttgcagtgagccaagatcgcactactgcaccccagcctgggtgacaagagtgacagcctggctgaccctgtatcaaataatatatatatatatatatatatatttttttttttttttgaaacagggtctccctgtctcccaggctgcagtacagtgctccgagctctgctcactgctacctctgcctcccgggttcaagcaatcctcatgcctcagcctcctgaatagttgggattatagttgtgcaccaccatgcccccgtacccagctaatttttgtatttttagtagagacgagttttcaccatgttggccaggctggtctcgaactcctggcctaaagcgttctgccccctctcagcatcccaaagcgctgggattacagacataagccatcaagcccagcccaataataataaataataatctggtatcaaaatgcatcaaaactctgccaccaacttgctggaccttggtttcatcacctccgttatgagaggttttgtttttcctgagatagagtcttgctctgttacccagattggagtgcagtggctcaatcttggctcactgcaacctctgcctcctgggttcaagcgattctcctacctcagcctcctgagtagctgggattataggcacatgccaccacatccagttaactttttgtatttttagtagagacagggtttcaccatgttggccaggctggtctcgaactcctgacctcatgatccgcccgcctcaccctcccaaaatgctggaattacaggcgtgagctgccatgcccggactgaggggctttaatatcaccatagagcattcttgccaaaaatggttaactagaatctaatttgaggaaaaagacaaatttagaatatgggacatttttaagacagctgatctgtctctgtaaaacaatcttcaagtcaaagtcatgaaacacacccaaaagacatgactggatggtgggtgaagggagagcagacctctaaagaacagttttggagataactgaggaattgtgactggactgagagtaacgaatattgtgtgatcttcttaatgtgcaaataataagatagattgatgtccttgctcttaggagcgaagtgtcatgatgtccacaacctactctcaaatggctctgaaaaaattaatacataaacgtgaaagtgagaggctgggcgtggtggctcatgcctgtcatcccaggactctgggaggctaaggtgggtggatcactcgaggccaggggtttgagaccagcctggccaacatggtgaaaccttgtctctactaaaaattccgaaattagctgggtgtgatggcgggcacctgtaatctcagctatgtgggaggttgaggagggagaatcacttgaacccaggaggcggagattgcagtgagccgagatcgtgccactgcactccagcctgggtgacagagtgagaccctgtctcaaaaaaaaaaaaagcaatttcacttctgggtatacatccaaaagaatcgaaaacaggaacatgaacagatatttgtgaacccatatgcatagcaacgttatttacaatgaccaaaaggtaaaagcaacccgtgtccattgatggatgaaaggataaacaaaatgtgttgtgtgtatacaaatgaatacacacacacatacacacatggaaacattattcagccttacaaattaaggaaattctaacacatgctacaaaaaagaaaaaaaaagagagaaagagaaaaaccaaatagcaaactgctgaccatgggcaatgtgggtggagggtgtactggtgtgttcatggttctattctttttttttttttttttttttgagacggagtcttgctctgtcgtccaggctggagtgcagtggcgtgatctctgctcactgcaagctccgcctcctgggttcatgccattctcctgcctcagcctcctgagtagctgggactacaggcgcccgccaacacgcccggctaaattttttttttttttttttttttttttttgagccagagtctcgctctgtcacccaggctggagtgcagtggcgcaatcttggctcactgcaagctctgcctcccgggttcacgccattctcctgcctcagcctcctgagtagctggggctacaggtgcccaccaccacacctggctaattttttgtatttttagtagagacggggtttcaccgtgttagccaggatggtctccatctcctgacctcgtgatccgcccgcctcggcctcccaaagtgctgggattacaggcgtgagccaccgcgcccggcctcatggtgctattcttttcagctcattggtatgtctgaaattttttcaaaataaaaagggagaaagagagaagagaggaaagaagagttggaatgagcccctctattcaaagccaatcccagtcttagagtctgggaccctgtgctagttggcttgggccgccgtaacacagtaccacagactaggggcttggataatggaaatttatttctcacacttttggagactggaagtccgagatcaaggtgttagcagggttggtaatgagagcaaagatcacctggtggccatcaaacaaaccatccagaggcagaactccttatctgaggaatggagaagtaattagactttcctgttatctgaagccagccatctggtgccaggcttctttcttaaaaatgtataagtaattagaatttctctacatctctggaatgcatgcatatagaaactcatcatgcaacccttgctgacatcaaggcactgaaatgtttacaaatgtaatcatgtaccgtgacctacgcggctaacatggtccaaattacccttaagttcccgctttaaggtccataaatggctctaaggaaaatctaccctggcacgcccagtcctctcgctgaagcgccccgctgaactctgctgcagcgttctttctgtctaatacaacttcccttttcaaacctatactgttgttggtaaattccccttactacccatgagccaaccattctctgctgccagcactctaacaccttgccaagcagttggtttctttagaagcctccctccccagcctgcagatggccaccttctccctgtgacctcacaaggcctcccttctgtacctgtctgtgtcctaatcttttcttataagaacaccagtcatattggattagggttcaccctaacagccccattttaatttaattatctctttaaaggccctaatacgggcggggtgtggtggttcatgcctgtaatcccaacactttgggaggtcgaggtgggtagatcacctgaggtcaggagtttgagaccagcctggccaacatggtgaaacccagtctttcctaaaaatacaaaaatcagcgaggcatggtggcgggcgcccgtaatcccagctactcgggaggttgaggcaggagaatcacttgatactcggcggcggttgcagtgagccgagatcacaccactgcactccagcctgggtgacagagcgagactccatctcaaaaaagaataaaattaataaataaatgccctaatacaatctccaaatagtctgagttactccaggttagggtttcaacatatgaatttgaggggattcagttattcccataacagcctctaaagccaccttgagcttcatccctcccccatattccacaggggcacagagagggctttcccagccaattccatttctctttcctgcacaggtctgaggctgagctctgggcagaaggaccctgctacaggcatcggctgggagggagagaaagggagaacctgccctcaaccttctcctcatccattcctagccaactcccccgaccacgcccagctgcccaggggccccgtcctgccagctctcctgcaaggaggcttctccctgccctggtctccaaggaacaggcttcttcctggagcccagggtccttcctgccttccttggcaggtgggtccctgacctcctgcattgtggtcactcccaaccaaacacctcccgggaggcggaagttgcaatgagccaagatcaggccattgcactccagtgtgggcaacaagagcaaagctccatctcaaaaaaaaaaaaaaaaaaaaaaaaaaagttgccctttcgaatccaagggctgctgtttttgcaagtggatgaaggctttccctgagtattcctcttgcttcctcccacctcctcctgtaactgaaggattgtcctgtcctccttaagcattcattctgcatgttaccccagcaggaccaggaaccccaaatacaaattttcctctattcctctaatcacttccatgcccttctcaagatgcatcaagaccctcaaggtcaggccgggcacggtggctcaagcctggaatcccagcactttgggaggctgaggagggcggatcacgaggtcaggagatcaagaccatcctggctaacacagtgaaacctggtctctactaaaaacacaaaaaattagccgggcgtggtcgcgggcacctgtagtcccagctactcgggaggctgaggcaggagaatggtgtgaacccgggaggcggagcttgcagtcacccaagatcgcgccaccgcactccagcctgggcaacagagcgaaaccccgtcacaaaaaaaaaaaagaaaaaagaaaaaaagaaaaaaaaagaccctcaaggtcatattcaaagggaaggaagtccagcccccttgaggcagctggctgaaaaacaggtttctcatatactaaaagaacttgggaaatgggaatcagaaatggataatcattttgttgctagcatgctccaagctagggtcattataaggtgatggagacaaggacataggctggcccaaggccacaggcacaggagacaaaaatacccgcaggacagagatgaaggctgatcccaggctaacagatgaccattagaacacagatgaaggccaggttaaactggtttattctggaaccccaaggatgaagagggagcccccggttcacttcagtatctcctctgttctcagtgggtaattatgatgagatggggccaaggttaagggtacacagtaagactggttcattccgaaaccctaaggatgaatgaggaacgccctgttcaggaaaggataacaggaaaataagaggatgccttcttttctgttttttttttctgctttgttctctctttgcaggtgggtaatcacgtcaccgtatgtcaggacatgcccctgcattctcaaaaactgggaagtttgatcacccaaatcttggaacaaaaagccacttttccttttgaatactgtttggcctaaaaatgaactgggagaaaattacaaaagtcagcctttctttctccaaaagaatccagtgcctctatgcaggaaatcctcaaattagccttctcaggtcttttataatcaacagcagaatgaggaggacagggataaagagacagagaaatgcagggaacagagagaggctcaactattggctgttttataagccctccagccccacccaggttgccctcagaatcccctcctaggtaactgccatcagcgccagaagccaggccactggcagataaactgcccccatgggataaatggggaaaagccccacatagcttgttccctttgccacaagctcagccactggaaacgggactgccctgagggtcataggaacccccccaggacagaatcccaacccctgatggccatgagctgaaggggttctctgccctggctggcttccaaatcagacattgtcattaacaggacaaagccaagggtaactttggaggcggcaagtaaaattataaatttccctcttgagttcaagagctgcctactctgtgctaatctccttatctgagcaactctcttccaaatcctgttgggtaatgggggaaaatggcaccttctttctccaaaagaaaaaaatctttatattacttaagggaccaaggagtttgagaccagcctgggcaacatagtgagaccctgtctccatcagaaacacaaaaaaattagccaggtggacgtggtggcacaggcctgtggtcctagctacttgggaggctagggtgggaggatcgcttgagcccgggtgatggaggctgcagtgagccgagatcgtgccactgcactccagcctgagtgacagagtgagaccccatcgcaaaaaaaaaaaaaaataagtcaaggatgatgatgatatagactcagggaatatcattaagtgaacgagaaattatctttattccccacttttaacatggggaaactgaggccccaggaagacaaccaagtattggctgaattgagctgagggagatctcaaatcactcaatagcgaccaccaccttcccaggcagctatcgaagttcccataatgggcagatggatcacctggggtcaggagttcgagaccagcctggccaacatgataaaaccccatctctactaaaaaaatacaaaaattagccggatgtggtataattacagctgtaatcccagctactagggaggatgaggcaggaaaattgcttgaacctgggagacaggttgcagtgagccgaaatcacgccactgcactccagcctgggcgacagagcaagactcgtcaaaaaaaaaaaaaaaaaaaaggccgggtgcggtggctcacacctgtaatcacagcactttgggaggctgaggcaggtggatcacgaggtcaggagttcaagacctgcctggccaaaatggtgaaacccccatctgtactaaaaatacaaaaattagctgggcatggtgatgggtgcctgtaatcccagctactcgggaggctgaggcagagaattgcttgaacccaggaggcagaggttgcagtgagccaagatcgtgccactgcactccagcctgggtgacagagcaagactccatctcaaaaaaaaaaaaaaaaaaaagttcccacggtgctgccgagcctgtgattggcagaggcattgtttattcgttcaaggttttttgttaagggacccggtgagtatcaactactaggcagttctcacttctgctcacttctgggctcacttaagcctaccagcagccctgaaggctgttaaccaccctttagagcttagagagtcgaagaggcaggggccaggtcctaaagaaaggcacactgtccccagagcctggggcgcgatgccacccgccccccccccccccgcccaggcgtacccccccttaccccgccccccacccgctcgccgcgcccagcccatctggcgccgctctgcccctgctgagtaatcctttcccgagccacgtggccgtgtttttcctgctgagtcacggtcccgaggtctattttcgctaagtcaccgccccgagatctgttttcgctgagtcacggtcccggtgtctgttttcgctgagtcacggtctagagatttgttttcctcagagttccagctgctccaggtttaatcccctggggcaaagtccggactgtccggctggagtctggagtcgggacatgcctcagccagcacgtcctcggcctcgtctggggcctgaatcctagggaagccatagcagctcctccacccttcctctcactcctcctctagcctcttgctactccccgcaccactgttttagggaacctctatctcccgacggcctgccacgggccaggcgctgtgctgggggcttcacactttaaatcgctgttgagcggggcgcgggggcgctgcaacctaaaggtgggagctactcaaatggaggggcatctgttaaaatggccggcctgtcattttcaaaaacttcaaggccgggcgcggtggctcacgcctgtaatcccagcactttgggaggccgaggcgggcggatcacgaggtcaggagatcgagatcatcttgtctaacacggtgaaacttcatctctactaaaaatagaaaaaattagccgggcgtggtggcgggcgcctgtaatcccagctactcaggaggctgaggcaggagaatggcatgaacccgggaggcggagcttgcagtgagccgaaatcgcgccactgcagtccggcctgggcgaaagagcaagactccgcctcaaaaaaaaaaaaaaaaaaaaacttcaaaggctgaggaacccaaagaggcaggacaagtgaatgcaatgcaacctcttgggctggaacctggactggtaaaacggctaaagaggaggttattggggcaataggggacatttgaatataggctttatattgaaggagttcaggatatgccacccaaaatgtgccactttggattaaggatcattattattattattattattattttgagacagggtctctgtcacccaagctgcagtgcagtggcacaatctcggctcactgcaacctctgcctcctaggttcaagcgattctcgtgcctcagcctcccaagtagctgcgattacaggtgtgtgccaccactccccattcattgattaaggattattttgagctggccaggcgtggtggcacatgcctgtaatcccagcacttggggaggccactgtggggggattgcttgagctcaggagttccagaccagcttgggcaacgtggtgaaaccttgtctctacaaaaaatacaaaatataaaaaatttgccaggcatggtggtgcatgtctataatcccagctacttgggaggctgaggcaggaggattgcttgagcccaggagattgaggttgcagaccactacactccagcctgggaaacagagtgagactctgtctcaaaaaaaaggattattttgggataaaggcactttaaaaacaaacaaacaaaatcaggtgcaaaaaggttgctgtgggttgggcatggtcgctcaggcctgtcatcccagcactttgggaggcaaaggcaggcagaccacctgaggtcaggagttcgagaccagcctgaccaacttggagaaacctcatctctactaaaaatacaaaattatccgggcgtggtggcgcatgcctgtaatcccagctactagggaggctgaggtaggagaattgcgtgaacctgggaggcagaggttgcagtgagcctctgaccttctttttttcttcctgaaagcaagagatgaaattccatatggaagacttttctctatacgaggagaaaattagcattcctttcatccatggcaggaagttgaagccaaaataaatctgtacaaacaaagcttgttaaagccagctcttcctagtctcttctctacccagttaaccaccctaacccacacccacgccactttgccttgtcacgttttcacagtttactactctgtgtccaaatctgcatgtaagtgtttggctctgtttccttgagtcttcttttccttaggacggctcacgtgttatgtaaatgtacgttaaataaatgtgtatgcttttctcctactaatctgtctcatgtcagtttaattctcaggcccagcagaaaactctaaaagggtataggtaaaattttgcctcctctacaatataatgaatttatatcgaagccagatttcctgatttttataaccatatgtcagggactgcactccagatataatacatgctaaataatttgggggtagataggcatggtggctcacacctgtaatcccagcactctgagacaccaaggcagaaggactgcccctgacgtcaggagttggagtccagcctgggcaaaatagcaagaccccatctctactaaaaatgaaaaaaattatccaggtgtggcggcatgagcctatagtcctagatactcaggagatggaggcaggaggagatatatatatctgtatatattcaaaaatatatatgcatagtatatcaagagagaatacgataaagcaaatgtgacaaaatgctaacaactggtgaatctggatgaaggtgtatagaaattctctgtactatgcttgcgacttttctggacatttgaaattatttcggagaagtttactttttgaggaaaaggtaaatacaggccgagcgcagtggctcacgcctgtaatctcagcactttgggaggccaaggcaggtggatcacctaaggtcaggagttcgagaccagcctggccaacatggtgaaaccctatctctactaaaaatgtacaaattagctgggcatggtggtgcatgcctgtaatcccaactactcagaggctgagggaggagaatcgcttgaacccaggaggcagaggttgcaatgagccgagatagtgccattgcactccagcctgggcaacaagagcgaaattccatctaaaaaaaaaaaaggtaaatatgaagaacctgagattcaaaactcctgactgaaatcaaggtttgttggatgttagtgacccccgccctactgcagaatcatccagaaatttctagataggaaaaaggctctggctgaatcatgaaaggggagctggatgcctctctgaccaacataacggttaacatttaccgtgtgcctcctctgccaagcctcactgtaagcttcttacatgcatcaaactgatttcatgctcaccacatccccttgagtcaatgctgttattattcctcattttgtcagatgaggaaataaaagcttagggtgttccagtgtacacagatgggaagtcatggatcctggatttgactgcagtccttttgcctagagtttattgctttagctagtctatactatcctaatggtaccttgatcaggttgaaccagggcataccagatctgggaggtatagtcaggctccattttggcaagactggcctggtagtctgcatccttcaaaggctagaatgccttcttgtctggctgtgggtcttcggtcactgggtacgtgctaatagaggctgcacgatgtttggaaaagatgttgccattctatgccctttgctgcctcgggcccaggggctcctagggcagcgatgctgtggaatctgagtgagccagacacacttggcctcaaatcccgggtgagctgtgtgatattaggcagggaatttcaccctgcttgctaagcctcgttgattaaatatgtagtgaaagcctggcttgtgctaagggcataagaaggtgaatctgacatggcccttgctgacttcaaggagctcacagtcaggacggaggtgggggcaactggggcccctggaggggtccataatgtgaggagaagagcttcaggaaagcctgtgtagaatctgttttacagcttcatgaagatataattggcatacaataaactgcacatatttaaagtatacaatttgatgaattttgacacaacttataacctgtgaaagcatctccacaatcaagataaagggtgtattcatcactctcaagtttcctagtactccttggtaatcccctcacttcaactaggtaaccagtgatccaattagactagcttgcataattttctagaattttatataattctatatacattatgcgtatgtgtgtgtgtattgctttggcgagctcttttattaggaatgttcatcttttgtctgttatatgtgtggcaaacacttccttccagtctgttggtagggtttcaaccttatttatggggtgttttggcatcagaagggttcggtgttttgcacttcagcctatggatttttttctttttcttttttttttttttgagatggagtcttgctctttcacccaggctggaatgcagtggtgcaatctcagctcactgcaacctccacctcccgggttcaagcgattctcctgcctcagctcccccgagtagctgggattacgggcacctgccactacgcccggctaatttttgtatttttagtagagatggggtttcaccatgttggccaggctggtcttgaactcctgacctcaggtgatccacccacctcagctcccagagtgctaggattacaggcgtgagccaccacaattggcccagtctatggatttttaaaaaataacttgggcttgtcttccttgctgaagaaggctgttttccagcctgtcacacagcagttaggctgtagaccctcactggagcccctgccctgcagaatcgagcacatgttctttctgggtctgtgtggggtgtgggtgtggtcaggacaccgtctgtgaccttatttactggggacgtcccctgcttgaggagaatatccaggcaaggtctcctcactctccttagccaccatccagcttggccaagaggcctccccatgattcctcccacgccagggcctcgcctttgtttttcactgttaggggctggcgagtcactgacccgcccccctccctgctgcccaaaccacttctgtttcctgaaggcgccttgggaatgctgagtcgcgatttcctcatcccctcgtgcagctgcatttctgctgcgtcatgtttgggaggggggactcgcggaaacaaagggaaggcggattttgctagattttgctgagtcaccagtgcctcctcagcttctctttaggtgggaggtgaaagggcagctttaatggtaggcaggaggaagtgaaacttctagaaaacggcagaagcctcttgtttgtcttttctaagtctgtgcctttcccctgctgggtcccccagctcccaccctgtgaagtccacctcaatctgcccctgatttaatgttgcaatccaccgaggccttcttatgcttcacatctctctgacttctgcatctgcctcatctcttctgcctccagcaggagaaagttctctactttttttgcctggataattattgtatttttagtagagatgggggtttcaccatgttggtcaggctggtcttgaactcctgacctcaggtgatcagcccacctcagcctcccaaagtgctgggattataggtatgagccaccgtgcccagcctcatcctccatcttcaaagctagcagcatggcatctcccagtctctctctctgtcctctgctttctttgtcaccttctgtatgtgcaaccatccagcctccctcttataaggcccaagaggataatccaagataattccccatctcaacatccttgacttaatcacttctgcaagatccttttgctatgtaaggtagcaaaaaggtaacctattcacaggttctggtgattagaatgtggacacctttaaggggcttttatttggcccagcaggaggagagagaatagcatttggatcatcctgttgcttgactaaaaagaaggggaagtcaggaggctgaatcagcatgcgaaagggccacaaattcagccctgggacagcctagaggaccagaacaactctggcctggcctcttgcaccccagcaacccactgtgtggggggctgttctaacgaagtctggggctcccagagaacagttagaaaagaaagcaagcccagaccggcagccaggaaccctgggtcactggaggttctctttccaatggggggcatagcctggccaagtccctcctgctcttggggtccctgcttccctgtgttaaataaaaagggttcagatctcatgagttttaccctctagggtcgctgaatggacagactctggatctatacacgcaaactcatctcccctaaactcctggaccctctgtgagaagggttggagtgtggtggtcaggactgtggggactggcttcaaagtgctgtagtttgaatcctggctcttccatcattaactgtatgacttgggaaaatgacttatcctctttgtccctcagtgctcatgtgggcaaaatagagatgaaaatagcttgcaaggctgttgtcaggatgggctgcaatcacgcgcgtgaagtctctgcacatagtaaattctcaataaaggctggttagaatgacagtttggaattgtggcttggttccagcccattctatcagcccagcaatattacagcctaacaatattattattttttcccagaaagagaccttgaagcatctattcattcaggcatgcattcagtattaactgtgacctaccaggcactattccaggaactgggaatttacaaagcaaagtagtaggcaaggtctccacctttgtgctttacatgccactgttggggctcagaaagtgataccaggacaactggtgctttgacatgatgagaggccttaggagctgcctcagagtcaaggtccctgtaagcttgtcttgttcccccgacaagcacagggagagacgctctctggaatttccttatctgaccaagaacacttctttacaaaagaaatgcaattgtgttaagtctttttttcctttgagacagagtctcgctcttgtcacccaggctggagtgcagtggcactatcttggctcactgcaacctcctcctcctcccgggttcaagcgattctcctgcctcagcctcccaaagtgctgggattacaggtgtgagccaccgcgcccggccagtgttaagccctttttctagtaatctcatcaaatatccaggaaagatcaaccactggagagagaaagagactgggagtcatcaccagacccagacagatttacctgttcttctgaggacagtgccaagagattacctgggggactttatctgcctaggacaacctttgtccctgtgcggctccacctccaccttcccttaaagtcggcctttcacctccagggccattccttcttgctaatgatttactgtctttcaaaagaattgtctgcattccctatctcccttctcccctataaaaaaggctgggtagcctctgtactccactgggttacagggtcaccattcttccgtgattaccccattacaatacatttttgtatgtcttttctcctcttaacctgacttttgtcggttggttttcggggaaccttcagaggaagaaggggaatttttttcaaggccccttagctcacccttgggaggatgatcctttccaatacaatctcagaagtgcctctgggctgtagtggccctaggctgaattccaggaagttttttttttttttttttgtttttttttttttttgagggacagcgtcttgttctgttgcccaggttagaatacagtagcgtggtcacagctcactccagcctctacatcccaggctcaagtgaacctccagcctcagcctcccaagtagctgggaccacaggcatgtgccaccatgcccagctaatttattttatattttgtagagacagggtctccctatgttgcccaggccagtctcgaactcaaagcaatcttcccacctcgactgggctcaaagcgctcttcccacctcaacctcccaaagtactgggactacaggtgtgagctaccatgccaggcctgaaagccatcttaaaaaaaaaatcttagaatgagaatcacagtattgggaaaggactgtatgaatcatctggtccattcgttttgtcctctgggttcacccagtgaccctatttcccccgagttctaaggagtccacctcatgcagaattgattcaataggcgatcagcaagggccagctctgctctgggccctgagcaggcactgagtataagtcagacctgaatgtgcctggaagagtgtcccacgcattccagcagggaagcagtttgtatgacaggtgtcccagtccaggcggataccaggtgctgccagagtgtggaggaggcaggcggggacttagtctcctccctgggtttggacactggcatcctgctttatgtgtgacaccactgcacccctctgagcctcggtttccccatctgtaaaatagaagcgatctaccctcacaggtcagttgtagggatgaaccatgaaaatactagagtctctgttttttgacaggaactcaaaaaacagatcctaaatgtacatttaaagagggtgtgaggaggcaagcagtcagcagaggattccagcaggtgacattttagggagctggagacagcagagcctggggttgctaagttcctgatgttgcccaccaggctattgctctgagcagcgctgcctcccagctttctggaaccttctgggacgcctggggtgcatcaagtcccaaggggacagggagcagaagggggggctctggaaggagcaaaatcacacccagagcctgcagcttctcagatttccttaaaggttttgtgtgtgtgtgtgtgtgtgtgtgtgtgtgtatgtgtgtgtgtgtgtgtgtgtgtgtgtgttttctctaaaagtcctatggccagactttgtttcccaagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacaggcaagcgcggggcgcgggacgcgggacgggcgcctttctctcccaaccctgcttgcgtcctagccccaccccgggacactgccacacagcgacagagcccaggagccagaaacttgggctctggagtcaggaggtgcggggttctgatcctgcctgtgcccgtagggtagttggagggaggaacggtaatttacatgcctggcaccctggtatgcggttggtgaccaagatgggagtgtccctagagtatccagtctttgaggtagccaattttttttttaatcctactttcgaggtgtgtttggagttgctctctgctgaatctagatctctggggctctgccagcctgggggagcatgcttggttctcttggtggcatctgtccctcactagctacggaggacctgagccagacatcaccctggctgcggtgttccatgtctcacagatagcccagttcagggaggcgacatgcccaagagtgctcagttagctggtgtcagaactgggccttgaaccttggtctgcccacctccaggtctcactcattcccttctttcaataatttgttagtatttttttttttaactcctgggcttaagcatcctcccacctcagcctccagagtagctgggacttacagacatgtgccatttctcctgagactttgaccagctgtgttgtagaacagggaagcagggcaggagaaaagggaaaaatgacaattctgtggggaggcagggatacggacccatgacagaaatactcccagaaagactttttctttgactaaagcagactttctcaggctttttaaccctgacgccttcatgatgagcataacatgatagggggtcatgagatttgcatctggaactttaacaaaataactgaattaaatattgggtctaaaagccaatcaaagcaattacaaacttggagatgccggttcatggggctgctgcttcttcctgggttatgctgtacctcctcctcctctccactgcgaactacctgtaccaggatttcccccttggtttgggggactgtattatttagtgttttaatgactgaagagtgtttacaaagctgcgagagccaccatgcccagcctgaatttgttttttgttttttgtttttttgtttttttgcttttttgcttttctttttttgagatggagtgttgctctgttgcccaggctggagtgcagtggcgcgatctcggctcactgcaacctctgcctcctgggttcaagcgattctcctgcctcagcctcccaagtagttgggattacaggcgcccactaccatgcccggctatttttttttttttttttgtatttttagtagagatagggtttcaccatgttggccaggctgggctcaaactcctggcctcaggtgatctgcccgcctcagcctcccaaagtgctaggattacaggcgtgagccaccatgcctggccctttttttctttttttttctttttttgagatggagtctctctgtcaccaagtctggagtgcagtggtgtgatctcagctcactgcaacctctgcctccgggattcaagcaattacaggcataattgctgggattacaggcacctgccaccatgcccggctaatttttgtatttttagtagagacggggtttcaccatgtttgccaggctggtctcgaactcctgacctcaggtgatccacctgccttggcctcccaaagcgctgggattacaggcgtgagccaccgtgcccagccacaaggctgcatcttaaagcgattgagaacgtggcctgaatgaggatgggagtctcttgaaggcctgcccacaggtgggaggctcagcagttgggaaggaccccacccccagccagctttgtgttcacctttcccatttcctcctcagcatgccccaggatttgtcagaggccctgaaggaggccaccaaggaggtgcacacccaggcagagaatgctgagttcatgaggaactttcagaagggccaggtgacccgagacggcttcaaggtatgtggcttggtgggactagccctggtggagggtgtggcaggtgtgggtggacccaaggctcagaccagtggtttaagtggggatgctgagggaccagatgggcatgtccaatagaatcatcttaaaaatgatgacactgaggctcagagagggaaggtgagttacccaaggtcacacagcaagttcagcctgctctgtaatgttgtggaggggctggggcagcagtgccgttgactgagcaccggttccatgttgggcattttgtacacgtggtttctaatctgtgcttcaaccctgacgagaaagatgaggactggaaggctcagagaggttcagtgactaacagaaggtcacacagccagtaagtggaaaaggctgaaatcaaccaagaccgatttcagccttgtactccttgtatttcagagcttgtactcctgatctaactcgaatttgcctctgaagataaggaataatataggttggagtcttaacagaacccttttctaacagtgagactgagggtgcctcatctaatctccctaagccacgttttccccatctgtaaaagagtatttcaacagcagggttttcttaagcacccactatatgccaggtactgattttgctgtttcccagcactgttgtgaaattcatgcaaatagaaggaaagcacttgatgaagaaccgggaagatactgggtgttaaaacatcagcgtggggaagagcttgttcaggttgaacagagggtgtgggggtggggagtagggagctatatcccaccaccttcatcccagtcccttttgcaatctgcaccctctgccaccccctacttccaacatgagacatgctttatttattttattttatctgagacagagtctcactctgttgtccgggctggagtgcaatggcaagatctcggtgccctgaaacctccgcatcctaagttcaagcgattctcctgcctcagcctcccaagtagctgggactacaggtgcccaccaccacacctggccaatttttgtatttttttagtagagacagggttttaccatgttggccaggctggtctcgaactcctgacctcagatgatccacccgtcttggtctcccaaagtgctgggattagaggtgtgagccaccacccggccgagacatgctttaatgaggagagatttaatctgtggttccaggctgggtggggtccttgggcctgtaatgggtcttcctcatcctcctcccctctcccttaaaaagatgaggtacacccagttgctgcagtgtgactggagacagtgggtgcagggaggtgaatgctggaatatcccatccccagccagcttagactttggattttgcctctaagtcacagggttctaaggaggcgccaagatccatgagagaatccagtgctcacttacattaagctggtggacgtggcacttatcacagcccttctcatgtgagcgctaagtgccaggctgccctctgtgctggcccagatcctctcacttaatcctcacaccagccccatctagtatgtggcaggtgagggaactgactagcacagttggctagcacagtcacacggacctcagatcatctgctctaggataggataggaagctgggaccagagaaagcaagtggctcacccatggtcacacagttaaggactggcagagttgggtaagaaccaggtccgtcacactcaaaaacccaggctcttttgtaccagactgcctggctttctgtcccctcaaggaatagagctgctttgaatgtttgtggctcagaaataactcagaaactccaacctaaatgtcttaactttgttctccttcaaatttaaacgggcgtattaatgtgtaacgggagttagtgccccaagccaaggtacactcaagacctgttgcctcagcccagcatgcagaggtggtggggttcagaataggcctccaggaaggagaattgtgccctgtagttggttacgcagaggtcaaaagccagaagcacatggccaatctcctttaagcactttcatttcagctgttcccctctcctgagccatggtgggtccctggcaatgcccggtcttcaatctagtttcatttcttactagctgtgcaacctccatgtctcataccctctctgagccttagtttccttttctgtaaaatgggaatagcaattcctttgttggattttttttttttttttttctgagacagggtcttgctcactctgttccccaagctggagtacagtgatatgatcacagctcactgcaaccttgaaatcctgggctcaagtgatacccctgcctccgcctctggagtagctgggactataggcatgcacccccacagccatacctggcttttttttttttttttttttttctgagtcaaagtcttgctctgtcgcccaggctggagcgcaatggcgtgatctcggctcactgcaaccactgcctcctgggttcaagcaattctcctgactcagcctcccgagtagctgggattataggtgcctgccaccatgcctggccaatttttgtgtttttagtagagatagggtttcaccatattgcccaggctggtctcttggccaggctggtctcgaactcctgatctcgtgatccgcctgcctcagcctcccaaagtgctgggattacaggcgtgagccaccgcgtccagctggctagtttatttatttatttatttatttttatttatttttttgagacagaatttcgctgtgttgcccaggctggagtgcagtggcgagatctcagctcactgcaagctccacctcccgggttcacgccattctcctgcctcagcctcctgagtagctggaactacaggcgcccgccaccacgcccggctaatttttttgtatttttaatagagacggggtttcaccttgttagccaggatggtcttgatgtcctgaccttgtgatcctcccgcctcggcctcccaaagtgctgggattacaggcgtgagccaccgcacctggccccagccagctagttttttaaaataattttttgtagaggtgggttttgggctatgttgcccaggctggtctcagactcctggctttaagcaatcctccagccttagcctcccaaagtgcagggattacaggggtttgagccaccacactgggccagtttgttagatctttatataaggattcaattaggctgcttgttttgcccagtggggtaaaaggtttttaggctgagaaagtgcatgatcgtcttttcctcttgtaaaaacccctctggctgctgtgtgaagaggattgtagcgaggggtggcagaaggagtcagagcccagctgcgaagtgaggagggcctttccaaaggcagtagtggacgggacggacagaggtgggggtcttctatgtggctggcggcctgacctgctcactctgctttcagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccaggtgagggtcgggcagcctggggcagcctctgcctccccccgttgttcctccaagggacccttctcattgtaggggagggtgctataggtcatggttaacacagggaaccagagttccagcactgccacttactagctgggtgatcttgggcaaatgccttcatctctctgtacctcagtttccctatctgtaaaatagggataataatggtacctatatcttagacttataaggcttgagtgaatttacagcagtaaagtccccacagcagtgtctggcacagaggaagccctcaaacattcactactgtcataatgggacatgagaatcagttgtagctctctgtgacaacagtctgtggcaatgtataagttgtgtgtgcactagtgtatagccaggttggcactcccagggttacaggtggcctctgccttccagggactctcagcctagccagagaggtttacctctttctacaagtgtctcaaatccagggggaaggtggggtttgcgcaaagcctggaaggatgaattcttgggcagaggtggaggggtgaggggctccttctaaccagatgtcatagagccttctctctctgccaccccctggaggtgccatggggcctggggctcggggtcatgccctcctggctccctactcccagccgtggattgcagaagattctggtcctggcccctgttacggaacaaggcctttcccttccaccctcccccttcagaaaatccagtccgtcttggaggaagaaaatctgtgtctttcagagaagtgtaggcaaaagaaaagggccaggtgcagtggctcgcgcctgtaatcccagcactttgggaagccgaggtgggcggattgcttgagctcaggagtttcagaccagcctgagcaacatggtgagaccctgtctctatcaaaaataaaaaataaaaaaaaatttaaaggaaaaaaatgtttttaaaagaaaagggatttggaatcagaactggctctcaggctcgtgcctataataccaacactttgggaggccaaagcaggaaaatggcttgagcccaggagtttgagaccagccctggcaacacagtgagaccccatctctacaaaaacatgaaaaaattagccagacatagtagcgtgcacctgtagtcccagctacttgggaggctgaggtgggaggattgcttgagcccaggaggtcaaggctgcagtaagccatgattatgctactgcactccagcctgggcaacggcaacagagcaagactctgtctcaaaaaccaaaaaaacaaaaacaaaaacaaaaaaaaacggctcttggctggccgggcgtggtgggtcacgcctgtaattccagcactttgggaggccgaggcgggtggatcacgaagtcaggagatcgagaccatcctgactaacacggtgaaaccccatctctactaaaaaaaagaaaatacaaaaaaaattagctgggcatggtggtgggcacctgtagtcccagctactcaggaggctgaggcaggagaatggcgtgaacccgggaggcggagcttgcagtgagcagagatcgcgccactgcactccagcctgggagacagagtgagactccgtattaaaaacaaaaaacaaacaaaaaaaaacggctcttagtgcctgacctctggatcagtccttgggcaaagcacttaacctgtaggagctacagtttcctcatctgcaaggctaacaaataccattcagcacacctcaccaaggctgaatttcacaaatctaaactcaagagaagaaagcagcggcagaagagtgcatgtactaggataccacttaatattatttcaaaacaagcaacgcagccttttgcatggagacacaggctaaggacatgggcggccacagtgaactctaaatccaggatcattgttatcggttgggagggcaagagcaggcaggggagccaattgggcttggaacatcttatctcttaaggtggatgaaagggatatgaattttctttctttctttctttctttctctctttctttctttctttctttctttttctttcttttctctctctctctctctctctctcctctctctctctctcttctttcttctttctttctttctttctttcttctttctttctttctttcttctccttccttccttccttccttccttccttccttccttccttccttccttccttcctttctttctttctttctttctttctttctttctatctttctttctttctttcttttctttctttcttgcagagtctcgccctgtcacccgggctggagtgcaatggggcgatcttggctcactgcaacctcagcttcccaggttcaagcatttctcctgcctcagcctcccgagtagctgggattacaggcatgcaccaccacgcccggctaattttttgtatctttactagagatggggtttcactatgttggctaggctggtctcaaacttctgacccgtgatgtgcccatcttggcctcccaaagtgctgggattacaggggcgcaccaccgtgtccggccaatatttttcttaccatcttgttatttccaaagtatttcctaacacaacttaaggtcctaccttcagctgggacctggtagcatctctcactgagataggcatgtgtgtcttttgtcttttagctctttgaggagttgcaggagctgctgacccatgacaccaaggaccagagcccctcacgggcaccagggcttcgccagcgggccagcaacaaagtgcaaggtgagagcatccaggaaggggcacttcctctgggctacacatggagggacttggctgtctgactgtagtatctctattcctctgttttctgaatgtttggtggtggtgggtgttgtttcctgctgccccaccccactgcccctgtaaggacaggttctcgctatattgcccaggccagtcttgaacacctgacttcaagcaatcctcttgcctctgcctccccacatgctgcagttacaggcgcgagccaccatgccagcctgaatgtttgttgttgttgttgtttgagatggagtctcacccaggctggagtgcagtggcgcgatctcagctcactgcaacctctgcctcccgggttcaagcaattatcctgcctcagccccccgagtagctgggattacaggcgcccaccaccatgcctggctaattttttttttgtatgtttagtagagatggggtttcaccatgttggccaggctggtctcgaactcctgacctcaggtgatccgcccaccttggcctcccaaagtgctgagattacaggcgtgagtcactgtgcccggccacctgcgtgtttttgtatgagaagtggagtgcaggcaaaaggacctggggtcaaccttcagcgtgtggctctgggcaagccatgagacttctccctacctcagtttccccacccgtaaaatccagtgaggttcagctacttctagcttattggctcagaagtgcacaagaacccctcagaaatcatgggaaactcctgcctccttaatttagactcctttttaggcctttggtcccctgatgtgggccagggagttggggacctgtatccagctatgaacccaccacaggaagatgtcccttctgagtcttgttgtgtgtgagcccctccctcatgtgcctaagaacgatcaaggctggctgtactgaaacatcttggaaacttccaaaaagaccaaagtgctccacaaaatgtaccctcactaagcctaaaacactgagggagggagtgtggctttgggatgggtagcaataaagaggtaaggcttagctacctcctggcaggttatattaggcctcccctcctgtgccaccctaacctacctggcttgtggctttctcacttgtgccagaccacacggacccctctgctaggggtttgtaaccccggagggcttggctatttggtggggtagggagacgtcaccctaatgaagcagttctcaaagtgtggtaccctggctgtgggaggtggtaatcctagtatcccctcaacggggtctgtgaggacaaagcatttttataacactactactatttttttggttttttttttttcgtttgagacagtcttgctgtcacccaggctggagtgcagtggcatgatctcggctcactgcaagctccgcctcccaggttcacgccattctcctgcctcagcctcccgagtagctgggactacaggtgcccgccaccatgcctggctaattttttgtatttttagtagagacggggtttcactgtgttagccaggatggtctcgatctcctgaccttgtgatccgcccgcctcggcctcccaaagtgctgtaattacaggtgtgagccaccgcgcccggcctttttttttttttttttttttttttgagacagggtctcgctctttcacccagtctggagtgtagtggcacaatcacagctcactgcagcttcaacctcccaggttcaagggattctcccacctcagcctcctgagtaactgggactataggcacgtgccaccacacccagattttttttttttttggctttttttaaaaaagccaaaaataaatgagaaaattagagtttcactttctcatgaatgtgtgttggcattttccaaaggttatgtgacatgtgatgctctctcatggatttgatggctcatggaatgtgtgcctgtatgttcttgtatgttaagaatttctcagttttggccgggcacgatggctcatgcctgtaatcccagcactttgggaggctgaggcacggggatcacttgaggtaaggagtttgagaccaacctggccaatgtggtgagaccccatctctactaaaatataaaaattagctgggtgtgatggtgcacacctgtaatcccagctactcgggaggctgaggcaggagaatctcctaagtccgggaggcagaggttgcagtgagccgagattgcaccactgtactccatcctgggcgacagcgagactccatctcaaaaaaaaaaaaaaaagaaagaaaagaaaagaaaaagaatttctcagttttaatatctaattttgtaaatagtgatagctatactcacacaaacaaaagctcttttggatccttggttgcatttgagtataaaggagttttggaaccaaaacatttgagaactgcacccctaatgcatcagaaggagcaggagcctttaatatgaacaacacacatgtaaatgtcacagtgtacctgcttgcttgcttgcttgcttgtacttcctgtgaccgcagccctgggccaccagacctaaggccctgttttctctggggaagcccttctcatagcccagggcggggctaggattgaaacccagctggtctggctccagagacctgccctggactctgtcctgcttctaaagacctagggagcacccactctgtgcctgaggaggcaggtggcacatctacccaggttgcatggttggctctggcctatcatgttttaaatcttttttttttttttttttgaaatggagtctcactctgttgcccaggctggagtacagtggcgcaatcttggctcactgcaacctctgcctcctgggttcaagcaattctctgcctcagcctcccgagtagctgggattactggcactcgcaaccatacccggctaattttttgtatttttagtagagacggggtttcaccatattggccaggctggtcttgaactcctgacctcgtgatccacctgccttggcctcccaaagtgctgggattacaggcgtgagccactgcgcccggccctatcacattttaataaccagggatgggactgaacttgaattttgacctcagagctcctgctttctagctcctgccccatcatcaccatgcttagcaaacgtgtgagtttgagaggaagatttacagctcagacctaattgctggcaaagtttaaggagaggacagggagcaggcagaagtctgaaaaccacgcctgggcccaagaatgttttcacaatgtggcctggctgcacagggaagaacagacagcttgaagaagtagtgagctgcccgtctttgaaggtattcaagcagtggctagagggacacctgtctgtggtcttgcagaatcctggcgttgggcagtgactgtaccacagaccctgaggccgctctgctttgctttcctatgacatcagacaccctgatgcacgcccacctgttaatgaccttgccccattttctctttcagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaagtagttttcatgggctttgttattcttggggaactgaccttttcctccctggtttcttgcgtgctcggtaggagaagtggtgatagggggttggcaggagctggtctgtttgagaatacagaaggtgagcttttcttttctttttttttttttttgagatggagtctcactctgtcacccaggctggagtgcagtggcgtgatcttggttcactgcaagctccacctcccaggttcaatcaattctcctgcctcagcctcctgagtagctgggattacagaagttcatcaccatgcccagctaatttttgtatttttagtagagatggggtttccccatgttggccaggctggtctcgaactcccgacctcagctggtccacctgcctcagcttcccaaggtgctgggattacaggcgtgagccaccgtgcctggcccaggaggtgagctttaagtagctggtgggcgaatatttgtgttgaaccctgcttgatgcaattctcgactttatggaagatggggttgccctgtttggtggaaatgagcagattctggggcaaaatttgtattttctgtccagtgactattagggactggagtgaaattcttaggttcaaattcctgctacaccactttgaggttagtcacttaacctctctgaggctccattttatcactggtgacatgaatatagtgatacctaactcacctatgtgtcctgagaagcaaacaagatgcaagtgaaatgccaacgccatacacagttagcacctattatgcaaagaaggagaccagtgttttgtgattcttgtactgtcgagtcacctcatctatgtcatccctgtgttgagggggtgtttccactatctgagggtcaggatggatttcactgaggtctgtccagctctaaaacccaagccctttctatggccctaagtcaagaaaatactaaatatgtagcctcccaatctgggaaagtgaaaaaccttttgctgaaagtgtcctgggcagagcatgggacaagattttttttttttttttttttttttttttgagacagggtctggctttgtcctccacactggagtgcagtggtgtgatcttggctcactgcaacctccacctcttgggcttaagccatcctctggcctcagcctcctgagtagctgcggctacaagtgcacaccaccatgcccagttaatttttgtattttttttttagagatggggtttcgctatgttgcccaggctggtctcaaactcttgaactaaagtgatcctcccaccttggcttcacaaagtgctgggattacaggcgtgagtcactgtgcctggccaaggtgtatttttttttttttttttttttttgagatggagtctcattctgttgcccaggctggagtgcagtggtgcgatttcagctcgctgcatcctctgctgcccaggttcaagcaattctcctgcctcagcctcccaagtagctgggattataagcacatgacaccgcactcggctaatttttttagttttagtagagacagggttttaccatgttggccaggctggtcttgaactcctgacctcgtgatccacctgcctcggcctcccaaagtgctgggattacaggtgtgagccactgtgcccagccaaggtgtttctttataggaccagtacctaaggactggaagtcaggagacctttgtcactagtctgactatgccacttcaaggctcattttgttcactggtaaaatgagaacaatacacatacctctcacagctggtgggaggatccagtggtgtccaaacaccagtctgtgcatggtggcatcagaattacttggagatacttaaccacagaatccagggctccacctgggatggggctctagaatttttttttttttttttttttttttgagacggagtcttgctctgtcacccaggctggagtgcagtggcgcgatcttgactcactggaagctccgcctcccgggttcacgctattctcctgcctcagcctcctgagtagctgggactataggcacccaccaccatgcccggctaattttttgtatttttagtggagacggaggtcacaggtttcaccgtgttagccaggatggtctcgatctcctgacctcgtgatccgcccgccttggactcccaaagtgctgggattacaggcgcgagccaccgcacccagcctagaatcagtatttttgaaaagtaccttaggagagtccaacgcgcacccaggtccaggagcacgtatggtcacgtatgcaaagcataggcattcaaatagcagctggagctgggcacggtggctcacgactataatcccaacacttttgggaggctgagacaggcggatttcttgaggccaggagtttgagaccagcccggccaacacagtgaaaacctgcctctactaaaaccacaaaattagctggaagtggtggcgcatgcctgtaatcccagctactccgggggctgaggcaggagaatcacttgaatccgggaggctgaggttgcagtgagccgagatcgcaccaatgcactccagccttagcaacagagcaagactctgtctcaaaaaaacaaaacaaaaacccaatagcagctgggactctcctgccctgggcccagtttcctcatttgtgaaaggggaatagatattcattgtactgacaaagaaaggaaggaagaggggaggggagagagagaaactatcttgaattttactaataggagaatggctgaataattttttcctatcaattgtcgaacaaagccagacactagttaaagtggtaaggacgaccgggcacggtggctcatgcctgtaatcccagcactttgggaggccgaggagggcagatcatgaggtcaggagtttgagactggcctgaccaacatggtgaaactctgtctctactaaaaatacaaaaattaaccgggcatggtggcgcgtgcctgtaatcccagctaccaggaggctgaggcaggagaactgcttgaacttgggaaacggaggttgcagtgagctgaaattatgccactgcactccagcctgggtgataaagcgagaatccgtctcaaaaaaaaaaagtggtaaggacagattttaatcagtaatgattattgcaacagggaagagagttcagtatgaactgaactcagctttaatttgtatagaggtattttaaagggaggttgaccagcctgggcaatatggtaaaaccccatctctacaaatgaataaataaattcgccgggcatggtggtgaggttgaggtgggaggattgcacgagcctgggaggtcaaggctgcagtgagctgtgattgcaccaccgcactctagcattggcaacagagaccctgtctcaaaaaaataaataaaaaaaataaaggaagattgagggaggaaggggtgggcaagtgattagtagagtcagggaagtgaaatattacaaaaggttaagtcagtgtaaatgcagtgaggctagctgtgtctgccagttggcaatgatcaaagttagaatttttgcctcccacagagcctgggagacagaggtcacatcctcggttgttgcctggaataaacggtaaacatttaccagcagccttgagttttctcaggcaggcaccttagcgggggctggctagagtcattttagagatgttagcagctgttagaaactgttagtgtttgtttaagtctttttttcttttctttttttttttttttgagattaagtttcactcttgtcgcccagactggagtgtagtggcacgatctcggctcactgcaacctccgcctcccaggttcaagcgattctcctgcctcaggcttccaagtagctgggattacaagcgcctgccaccacgcccggctaagttttgtatttttagtagacacagggtttcaccatgttggccaggctggtcttgaactcccgcctcagcctcccaaaatgctgggattacaggtgtgagccacggcgcctggactgtcttttttttctttttagagatgagtctcgctctgtcgctcaggctgaagtgcagtggtgcaatcaaaactcactgcagtctcaaactcctgggctcaggccatcctcccaccttggcctcttgagtagctaggacaacaggtgtgctccaccatgcccagctaattaaaaaaaaatttcaagccgggcgcagtggctcatgcctgtaatcccagcatcttggaaggctcaggcgggtggatcacctgaggtcaggagttcaaggctggccaacatggtgaaaccctgtctctactaaaaatacaaaaaattagccaggcgtggtggcacacacctgtaattccagctacttgggaagctgaggcaggagaattgcttgaacccaggaggtggaagttgcagtgagccgagatcgtgacactgcactccagcctgggcaacagagtgagactctgtctcaaaacaaaaaaaattataaaaaaatttctagagaagcgggatcttgctatgttgcccaggctggcctcaactcctggactcaagggatcctctcatcttggtctcctgaagtgctaggattacaggcatgagccacagtgcctatagatcaaggttgaggcttagaagtgaagggagcccagaggaacctggctagagtttggtcaaggagagtctttgtcaccatactacagaaaattaagcagctgttaaacagaatgaggccggtctgggcatggtggctcacgcctgtaattccagcactttgggaggccgaagcgagtggatcacttgaggccagaagttcgagaccagtgtgggcaacatggtgaaaccctgtctccactaaaaatacaaaaattagctgagcatggtggcgcctgcctgtagtcccagctagttgggaggctgaggcaggagaatcgcttgaaccggggaggcagaagttgcagtgagccgagattgagccactgcactccatcctgggggacagagtgagactccctctcaacaaataaataaacaaataaaagcagtgtgttagggtgcgagaacccgggtcggggacgcgggtgagccgcgcggtaatcgccctgtcctgccaccagctggaggacaggggctcctcagagcctcaggcccagagaacgggccccacgaccgggaagcgaatactccacagggcacagtctcccaatgcaaaatgggcacctggacccaatcatttctgaacttctagttttttctccctatggctatgaaaagggtcattttttttcataggactttaaaagaaggcttaagaaaagcacgcaggcctggccgggtagctcacgccagtaatcccagtgctttgggacgtcaaggcaggcgggtcgcttgagagtagagtttcgagacctgggcaagatggtgagactccgtctttatgaaatattttaagaaaatcacgtacacctgtggtccccgctacaagggaggctgaggcggaaggattgcttgagcccaagaggttgaggctacagtaagccgtgatccagccactgcactccatccccggcaacacaacgagaccatgcgtcaggaaaaaaaaaaaaaaaccaagaaaataaaaaagaaaccacctaaaggcgtcctccgcgcgcccgcccctccgccatctttgcgtccgccccgtcctgcgccgccacttccttcccagccagaagtttcgcgccaaattgttccgcacacaaaatggagcccggaaggaggcgaggtcatgcactttgcagccaatcatcttcggcagacagtccgggcggcggggctggagggctcagaacggtccaatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcacgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttctttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcgtggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagaccctgtatctaaaaaaaaaaaatttattagctgggtgttggggcagacacctataatcccagctacttgggaggctgaggtgggagaatcacttgaccccagaaggttgaggttgcagtgagctgtgattacaccactccactctagcctgggtgacagagcgagaccctgtctcaaaaaggaaaacaaaaaagattctactgagggggagagggtactgagcttgggcccctcatagtaacctgggtggaaggttttgagatctttgattagggttctaacctgggcttgcatatcctgaaattgcatgcagatgttctgaggagagcggatctgtagcttctgttaacttcattagtggcaacagagtatgtaggggtcaggctcttgctccctgggcaagttatgtgactttgtcaagcttcagtttcctcatcagtaaaatggggataaggacagtccttaatctctcagagggctgcttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagtgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaaaaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtcctcaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatccctgtaataccagcgctttgggaggccgaggtgggcggattgcttgagctcaggagtttgagaccagcctggacaacatggtgaaaccctgtctttaccaaaaatacaaaataactagccaggcgtgatatgcacctgtggtcccagctgcttgggaggctgaggtgggaggatcacttaagcccagaacggggaggttgcagtgagccaagattgtgccactgcactccagcctgggtgacagagtgagaccatgtttcaaataataataataaataataataataataataatagctaaaatgaagggccagacactgcttgaagtactttgcatatatttacttagtcttcacctcaactgtgtggcaggtactattacccctgtgttaggggtgagaaaactcaggtacagaatgggtaagtgtcttggcccaggtctcactgctggtaagcattagagcaggatgtgattgaacccaagtgtctgatgagctgggtcctctgctgcgttgttgaatgggtctgcggggatcagagccagagaaggtctgacatgatccgagtggcggggttgtatagggcgagatggtggtctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgtgtgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttctcacagattttcaataataataattatatacatagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaatatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttgtcgtacagcgctttggtgatcttttgaaggagctaaaacccaggggttgagggctctttgaatgcactaccagtggggggctggtgggtccctgattcagcacctctgccagggtgagtgggtagtccctgggtcttcatccaagtctgagctctgtgtggcccagtcttgagaggcttgggcccacagctgtgagtcagggagccctggattctaatcttccctctgcactaagtccccaggtagccttggggagttccctccctccctctgggtctcagtctccacatccttaggatggttgagctaaggctttccctacatcagtgactgtcagttggcctgggggctagaggggaggggatgggatagggtagatgctgatcagacttccccacacctaccgtcccaggagagtctgaggtgctcccagcccctggactgcagtcaccgccaagcctcctgtgggtgtcatcagcttgtcgtgtcttcagatgtgttgggtggaggagtttgagactgctgcaaagcccaccacccagtgggcctccatgccgctgtgattgtgccattgttcattacatgtatgggggaccttgtggcaagacaccacacagcgtctaacagtggggaagaggcggttttcaccctgcagacgtgcctggcttttcttcacctgttttttaagagaggcacccatatttctccccagtgttgatgtttgtggcagctgcccacagccagatttcacttaaatcttttccgattgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcatccgcctggtcattgttgaatcacaaatgtatttttgtgcagaagattcctgcagctcaaagccctttctgattccatactgttcggggaaatggagagatgagaggagctaaatcagctttcctctgactcactcccgttcaaagctcatttcttttctgataattttgagagtgtctggaacagcttttgttttcttggtggggtggcaaccttactgggcgcgctgtgggttttgcatccaaggctgcatctccggttcctgctagcctttcatcttgctcaggtggggactcgcgtgcatctcaggcccaaggtcctcccgtcctgcttgttcatggagtgtggaactctcatgaggttcaccctgcagtggcaactttgctggtggccttttctccacccctgtggtgggtggtgctgctgtggtcacctctgttttacaggtggagaaactgaggctcagagagtcaagtgtcacagtgagggagtgcagggcaggcttcaaacctggtggctccgaactccacccatgtcaccttttctgccagattctctcttggcagtccctgacctcggcctgagtgggatgctgggcagagacagtcctggcctgggggaggcaggtgccagtcaggtgggggagactgaccctggggtaggttcccaggggtaggtggcctgactggcaggcacaggactgagaggccaaagggggtccgactggcttttccgtggtagttggggtagggctcataggaggagcagctgtgctcagagcatgccagtctccttccagatcggggcagcagcatgaagagaggcccctgagccagggaaacacctgcttgttggggaaagcaaaggctgaggagagagcctgaagggaggccaggagaggggagcattcaggctgagtaatagttggggctcggcttagtggaatctccagtcaggcctcagtgacacctagagaggcagggaggtggggcaagggggggagctggattcccgagctggtgctgccactcagggtggctgagctcttcactcacctgtgacctggctcccttaggcttgtcttctcagatctgtccctaccctcaccagctacaggccgcgacccagcggacatttctctctgctgagcaaatcacttcacccctcagcctcctttcatctgtagaaagggcacagcagtacagtagccctttcacccaggggtggctgtgaggattaactgagggggtagacatcagagcagctgggcctggccccggggaggtgctcccaggaagggctgggtgcctgtggttttccctgcctcacagcctctgccatctcggatttcaccttttcatgcttttgtgtgagcagaggccgagcctctgctgctgtgttccctgccccactctactcctggctgcatgggtctctcaacttcgctcaccactatgagagccgctccaccccttctccagttccaggtctgggaaggagagagcagacaagcttgctcatgatggagtccttttacctggtttctctctctgttcacagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaactattatccatatgtatttaaacatgaatacgtctgtttggtatttaacacattttttttttttttggctttcaaggcctttatttttttatttttatttttttcccttttttaatttattatacttgtttttggggtacatgtgcagaacgtaaagttttgttacatgggtatacacatgccatggtggtttgctgcacccatcaacccgtcatctacattaggtatttcttctaatgttatccctccctagccccccaccccccacaaatgtttaattaggagtgtcaagtctggatgaaccaaggtagatatttattttaagacattatggtgaggccaaagagtacattaaaatggttttaatttgtttttatagatcaaaaacaagcattttttattaaaaatatgaggcagtaaagcacagtggttaagaacatggacttggggccaggtgtggtagctcattcctgtaatcccagcactttaggaggctgaggcaggagaatcacttgaggccaggagttcaagactagcctgggcaacatagtgagacccccatcgctctctctctctctttttttttttttttttgagaccaagtctcactctgttgtccaggctggagtgcattggcgcgatctcggctcactgcaacctccgcctcccaggatcaagcgattctcctgcctcagcctcctgagtagctgggattacaggtgcccaccaccacacccagctaattttttgtatttttagtagagatggggtttcaccatgttggctaggctggtttcaaactcctgaactcaagtgatctgcccaccttggcctcccaaagtggtgggattacaggtgtgagccactgcacctggcctattttattatttttttagagatgggggtggttctcactgtgttgcccatgctggtctggaactcctgggctcaatcgatcctcctgcctcggcctcccaaagttcttagattacaggtgtgagccactgcaccagccaggattaaaggagttaacagccccaaagcactcagaacaccaccaggcccagggtaaaggctttttcagtgttccatatgtaaactatctacatatgtagatagttttttacatacgtaaaaaacctactattgacgtatgtaaacctacacacattggcttgctctaacagaagggctgtgttgtaaggtagtaagctccctgtttctgcacgtggtcaggtagaggcaacccagcatctgttggcgggcttggtcttccaggtcagggagacttctccccggctcctactcagggctcaccaccacctatttcatacttactagttgttttagagacagggtttctctgtattgtctggtctggaatcctccagctctggttattcacaggcatagtcacagtgcactacagccttgaactcctgacctcaagcgatcctactgcctcgacctcccaagtagctgggactacaggcgcatgccagtattcccagttcttttctttgacctttttttttttttttttttttttttttcttttttgaggcggaattttgctctgttcccaggctggagtgtagtatcatgatctcagctccctgcaacctccgcctcccaggttcaagcaattctcctgcctcagcctcccaagtagctgggattacaggtgcctgccaccatgcttggctaatttttgtatttttagtagagacaagatttcaccatgttggccaggctggtcttgatctcctgacctcaggtgatccacctgcctcggcctcccaaagttctgggattataggcatgagccaccgtgcccggccaaatctttttgaaatgctaggtcctaaggttattatctccaaattacagatgagaaattgaggctacaagactttgaggaaatgactcaatgtctcagaggcagaagtgaaggatctgggtgagccaccaagggtcgtcttcttaggagatattattgccttcaagatttcaagattgattgttccgggctctgagattctagaattctctcctgccattcctcctcacccctcctgcccttgttttttgttcttccttttttttttaagatggagtcttgctctgtcacccaggctggagtgcagtggcttgctctcttggctcactgcaacctccacctcctggttcaagcaattctcctgccccaggctcccgagtagctgggactacaggcgcgcgccactgtagctggctaatttttgtatttttagtagagatggggtttcaccatgttggctaggctggtgtcaaactcctggcctcaggtgatccgcccacctcagcctcaaaaagtgcaggcctgtgccaccgtgcccagccattttttgttcttccttagagaaccagctcagcctagtgcttctcagccagtaggcctcattctagagcaagacttctgggctccatgctcaatagctgtggaatatattaccctctccaaatctcagtttccgtgtctgtaaaatgggtcgggcttttctggtgttaacaccgaaagtcttgcatcccaggagccccttcagccctaggcacacccgttggtcaccctaaaaatggggggaataaaagcccatctggaagagttgtggtcaggttgggctgaacagcgttcactggtattgagcatggtacctttcaggggcctgcagagaatgggagagaaaattactgctccttacacagggtgacggagtccatggcctgagtgtgacacctaatgccaccacttccagctgtgtgccctgagttcagtttatcttcctgggtctctgttcccccagatgttaagaggattgataatagtgtgggctgagtatagtgagagtataggaagatacagtgaaataacaagagctttgccaggaagtgggcacctggtgcccgctgggcaggagtgcctgtagttaatcattatgtgtctcaaaaggtgtcaaaagctt

SEQ ID NO: 195 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 196 - DNA, 6126 bp, Homo sapiens
cagacaaggacagaaagggggctggaggagaaagagagagagagatacagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggccccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacaatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttagaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgaaaaaaaaaaaaaaaaaaaaaataaaaaaaaaaa

SEQ ID NO: 197 - DNA, 6008 bp, Homo sapiens
tgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgaaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagttgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggcgtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggctaaggtgaaggagatgaacgagaggctggaggatgaggaggagatgaatgctgagctcactgccaagaagcgcaagttggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggagtccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccga

SEQ ID NO: 198 - DNA, 1497 bp, Homo sapiens
accaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaag

SEQ ID NO: 199 - DNA, 2088 bp, Homo sapiens
catgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacgcttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtgaccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaaaaaaaaaaaaaaaaaagcgttc

SEQ ID NO: 200 - DNA, 1611 bp, Homo sapiens
gggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgcaaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctatcaagcaatcaccacaagaaagggagggtacgccaggcgagcccagggcacagatgctgagacagcctctccttytcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaaaaaaaaaaaaaaaaaaaaaaaaaaaaaaaaaaa

SEQ ID NO: 201 - DNA, 2376 bp, Homo sapiens
gatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgc

SEQ ID NO: 202 - DNA, 1559 bp, Homo sapiens
cccaggtgtgactgaggtgaccatcatagaaaagccttctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaaaaa

SEQ ID NO: 203 - DNA, 6015 bp, Homo sapiens
aaaggaataactgagaaacagagaaaaaaaatgtctctcccttctggttcttccagaccacccactcatccatcttgttcaatgacggcttctcttcctttaattaatcactgtggtatatttataaagcttatatttatgaaagactctttaattttttagttattaaagccctttctctttgtcaggttgtaactgagtgagctctggagtttggaaagaagatctcagaaatgggccagagagctccttctgagatccaagcacggagaattgcacctgctgagcatggtaagagagtgtgcttggtagctcacaagggcaaggtgagaatagaaactttcatgcctttttgatgggggttatgaaatcctaccaagaaacaccaggtatcagatgtggggtcctgttttcccaaagccacaaatgcttgaaggaagatcttgtgtgataaaacaattaccacatgaaccaatcttgcatgcacagcaattttgagagcccatcctgggagctaggtgtgtagtgtttatcgtattgttgaggctcgtaaaaatcttgtatggctgcaggcaagccaaacccttgacaggcactgcatctccgctgactctagaagaccaagcccaatttcttccctgtatataaggggaagtctctatgcttggggtagaggagtgtttagctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggctttggtggaggtggttttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgagtttctctctcattgcactggtagctgcgccggtccactcgggatcggtgcagtcaaaacacacgcaggtttgaacctcaagtttccacgtttacacgattaaaaggatgttttgcgaacggtcacctaaggagtacagttagtagtatgtctgcggtcgcctaaccgtgaaagggagatggtgagtgaaacatgagatgtgtgttattgttagcagaaaacatgtggtcagtcagtcagtgccgaacatcttttgctttcggaagggagctcttcctttcttaataatttacattggtacttggatgaggacacgaggagaggggcgaggggttttttagccaaatatttccaaaaaccggcccaaaaacccggataacccattttttaattttggctaacataagggccaaccagggaaccacaacaaaccaaaaccaagttaggatttccggcaacctgaaaagggggccaggccaaacccggtttttgggtaataaacctaacaaaattttggaaggcaaacctttaaatactagtgtacctaattccaaaaccttatcgccattaattccgatgccccttgccattggtatttggttaggtactcccttccaagccctctctgaattaacaggttgggttttattatgcggatggtattaacttggtcatcttcttcctatttctctgtcatggtcggaggatgggaattggggttcctttccaaatggggcacggttctccatggctatgagactccatttatgcatcaggagtaaaggggtcttgtgtttttaggtgaggttcctggagcagcagaaccaggtactgcaaacaaaatgggagctgctgcagcaggtagatacctccactagaacccataatttagagccctactttgagtcattcatcaacaatctccgaagaagagtggaccaactgaagagtgatcaatctcggttggattcggaactgaagaacatgcaggacatggtggaggattaccggaacaagtaagggaccctgtctgggcagttcttaacttttgctgtaaaaaagagttccaagaaaagtaataagctaagatcatgaagcagcatgtactatgtcttttcttaggttagaggcacatcagttcgacattttcagaaatcttcattttctccggagacggaaatagtctagcggttttattgctcagtagcgagtaagcaggccaataatgttccaaggttcataataagcaaggcagtgataggcaatgccatcctttagtttagaatgctggacttcaggtcttaccacctctgaatctcctaattgtttctgcaaacctgcaggtatgaggatgaaatcaacaagcggacaaatgcagagaatgaatttgtgaccatcaagaaggtaagcaaattctgtaggacggaactcacatttgaaataaataagggaagaggtttttgcttggagaatccctcacaggtaatgagagggacctgccctggagagaacgtgccttcatgatgtcccttgttcctctaggatgtggatggtgcttatatgaccaaggtggaccttcaggccaaacttgacaacttgcagcaggaaattgatttccttacagcactctaccaagcagtaagtcttccagtttcaaccaagtttatctaaatggagagtttttaagccggaacccacaacgatctagaggaatagatatttatcttttattccggactgcttctctgtctaagttgtttttgttttagtgctgtaagagtcactaacctattattgtcttgcaggagttgtctcagatgcagactcaaatcagtgaaactaatgtcatcctctctatggacaacaaccgcagtctcgacctggacagcatcattgctgaggtcaaggcccagaacgaggatatagcccagaagagcaaagctgaggccgagtccttgtaccagagcaaggtgagtggctgaaagcctagccagtttccctgaaatggcttgtcttgctatcctgtgttatctcatgtatgtgtgcctgtgccatgctgagttctgcctacatttaacaaacgctatctaccatctttagtatgaagagctgcagatcactgctggcagacatggggatagtgtgagaaattcaaagatagaaatttctgagctgaatcgtgtgatccagagacttagatctgaaatcgacaatgtcaagaagcaggtatgtgctttctccttctaccactcagctgtatggaatgggggtaaccctacaggtaaagggcgagtgctttcctagttttgaatcttgcaattcatcccaaggctacattattatccctgttccttttgtgatctatacggcagtttccagaatagaatagcagcaaccatcatactgggttcactttaaggaaatctatgaaaaatgggagcggggaatttcgggttggagtattcgaagaaagtactgacttgtacgggattgaacgaaaccttaactcggaaaccgcagaggactgattgagattctcccgtaaggtcttttacgagaaagatcaacatggtaaatgtgttatctggaggtgggtgtgagatgacttaaggccaagtggttctgttgaacacattattggcctcactggagtggggagaccaattgggatggaggcctagtggggaatgcatattatgagagggtgtcatattctttttcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgtgactaccaggagctgatgaacaccaagctggccctggatctggagattgccacctacaggaccctcctggagggagaagaaagcaggtgaggaagggacgctgggagtactcgcccccttcccctggtccttccttccttgccaccgaatgatgatgaagaagccgcccaccgaatgccgcctgagccgggaaaggggaaatgaaaagaactcgagccggaggaaggcatccgactttaccttgggagccggagaccccagccgaattaattttttcctccggcaccgtttaccataccgacaagagaccttgtggagttaaaccacttaccttaccgggtcgaaccgcaaggtcagctggtaagtgaagaagtgtggctacgaaaggtttccgaccgtgagattctcttgtagggcggggcaagttaaggtcgtggaaacacatggttcagttcctggaattgtcctggtgaaccttacggctccgccaaatgtttggttccaaagcaattccacaggtgattcggaaatctggcattattggaatttggctcaaccgcctgggagctgtgcccttgatgacccggctaaggccagctggcgcacatttgggtttggcagggaaaaaagggctgggcttgggtaggcctggaggggatgggattggttgcggttaagtgcatggggaggcccaggatggggaaagtcttcaagatggtgaagcggggaatggggaagcggtgctggagtgtcctgaggaattttcttattttctcctacaggatgtctggagaatgtgccccgaacgtgagtgtgtgtaagtacaagtcgatttctcaggggcatgtgcaggctttgttgggctggaaacggagttgaggttgaaaataactgagcttcctcttgcagctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtagcagctacggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaggtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagttcccttgctatgaccctgctttgttctttcccgagaaacagttcagcagtgaccaccacccacatgacatttcaagcaccaccttaagccagccagagtaggaccagttagacctagggtgtggacagctccttgcatcttaacactgtgctgttttggttttgtacataaggtgtaagcaagttgtttttcttttgtgaaatggtcttaaactccccatttccttgttttgctgctaataaactgcatttgaaattctccacgtctcagtcgccctcgttcacgcacacagccaacttgg

SEQ ID NO: 204 - DNA, 2658 bp, Homo sapiens
gggaattagtaccaagaaaacactagtataattaagaaatgttcagtttgcacaaagaactatccagataacccaccagcatgttagtgagatggaaatacagacccacaacagtaacccaatacttgcaggggttgggggcacggttatagattcaaccattgacctaagtctgcgtagcactgggaagaggctttggtttagaagccaaggaattgagtatattggggagaacagattatttacaagatgaactctttaatgtttgtgagaatctcaagtttcagagtttctcttttgagaaagaaaaaggggtaataaggtagaaattcacaccaatgaacaagaggattgctgcaaagtaactgaggagatgtctcgccattgggaccctaatgccatttttggtcaaacattgttttgagcaagaatctggcaaacaaaataatcaacaacaaatgtgaatatagtttcatttacttttaatttttaaatctgtggaaaagtttagttgtgcttcttgttaaaaagaacatttctatccctgaaaatgctatcttgggcttatgattattgttaaactccaagtataaactgaaaaaaaaaacatatccctaactctgttatgaaaaatggagacttctgatattaaatgctttcttctacttggaagaggccagagaaaacagggaagagaaagacattattgagtttgaccatgtattatgctgaataaacaataagcactttagagtccctccctcaaactctcatacatttcatatttcttttccatttattttcagttttgttttagaagaaaagttcatcagagaattttgttctgataatttcaagtggccatcttaggtcagtggaaaccgtaagtccattggactttacctcatcctttctttgtagacatctgggagaggaagaggagcttgtaatgatagcacggggatggtgctgtaaacaggagtgaaagtgtttgtggaagtccagagaagtgactcaacaggctacctagctgcagaacaaggagtagagcccacatatccagatggtgttttgagaggtgcgtagacagtgaaattcaattaaagagaggattttctcctcagcctcatgactcagaacagctccctaaatacctctctcatctaattggacccatccatagtccattctcaaacatgtgacattttcccctaagtagatgtgattatctcttaggcatttgttgaaaaataattcttaggtccatggtgcttgcacttgtgtcttttctataaaatgtttggtcttacaggtttcatgtcatttaagctgcacttctcagcaagttaaaagattagcagttaatctttattcatttggcctttgtgaatttgtatttaaattatttttttcaggattggcaaattattcttgtttctcctttacaaaaaaataaatgcgatattttgttcaatgaccccaaaaccaacttgaaacttaggtggtcatattggcttgcaaagcaatgtccctaattgtaccagtcagtcacacaagtggattcaaggacctgctttgccagattgacctgtcaccaagctcacaacacatatcctccacaaacaacatgtgttatgtgaagaaaaatggtaattataaataagaacaggatataacacacctttcatccactttaaatctccacagtttcattttatgtcattctctgagcaaatctctttgggatgtgagctagcgtgttcttctcccatttggaatataaggctgggaatagaacaatgcttaacaaatcagtgaagctcgacagtaatatgtaattttaattcagttaggaaagagttgtattgcattgcaacaagttgacaaatcatagccatctctgtagggtgtcaggaattatctcctggtcaactttaatgataactaggggtccctaagtgggctaacatgtgctgcattggagagaagccaagggctgagagtacagtgccaaccacgtaatgaattgcttgcagaaattccaaagaggactcagccacttatggatttccacacagcatcttttcccagctccacattaagacacaggatcttaaaagtaattttttaaaagctggctgtgtatttatttatatgaaagtgttataaatatcaaagcttacaaatacattaatacatatcacctttgttgaagctagcaaaatggctcaaaattgagactgtagagaaaaatccatgaaataatcacgatagtcataccacaaaagatagcatagctaggtgggcctacctggtcgtatcaacacactttcagatagatgcttcaaaaaaaaagggaaagcttgttactggaatcttatgtgcattacagtttaatttcttcttgtgacaaatggtgctcaaagaaggatcaatccggttgcatccttcaatttcccttttagaatgacttttggttttcattacagtaggctatgttagcctttattttggtggttctcaaatacctggtgacttgaaagagtattatgctggtggcctttcataaaggttactgaactttaatcaggggtgagatgaatgaatgtgaataggcctatatactattttttttaattaaaaaaaaaaaaaaaaaaa

SEQ ID NO: 205 - DNA, 3079 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtatt

SEQ ID NO: 206 - DNA, 3228 bp, Homo sapiens
gcgccgaggatgaggaggtgcaacagcggctccgggccgcgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactcgatcgccttcgccccgacgtggaaggcgctggccgaagacgtcaaacgctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtcgcgagggtcgtgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctgggtggccctgaaaaagtttgtggcagttctggccaagtatttcctgggcggcccttagtccagaactttctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctcctgtgggtcctcttccacttctagactgtgcaggcagctcggatcaaaatgtagaccactcacaggaagcacgcaaggccaaggaggtcctcccagccatccgaggctagctgcactacttcttcggctgccgagactgcgcaagccacttcgagcagatgctgctgcctccatgcaccgggtggggagtcccaacgccgctgtcctctggctctggtctagccacaacagggtcaatgctcgcttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgccggagggatgtgcagaatgtgcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagacgttcagaggaatgagcaggacgagccgcttgggcagtggcacttacgaagcgagacacaggggctgcattgctggctgagtccagggctgagaagaaccgcctctggggccctttggaggtcaggcgcgtgggccgcagctccaagcagctggtcgacatccctgaggccagctggaggcccgagctggacgggccgaggccagtggctgcaggtgctgggagggggcttctcttacctggacatcagcctctgtgtggggctctatccctgtccttcatgggcctgctggcatgtacacctacttccaggccaagataaggccctgaaccggatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttgcctcgtgcagggagggcacgcccggcgagtggcgatagggcagctcagtccctggcctcttagcaccacattcctgtttttcagcttatttgaagtcctgcctcattctcactggagcctcagtctctcctgcttggtcttggccctcaactggggcaagtgaagccagaggagggtccccagctgggtgggctggaatggaactcctcactagctgcctgcgcgcccaccctgctccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggaaagccatggttgctgggctgtagggtgatggtttgtttggtgggacctgacgagttggtggcatgggaaggatgtgggtctctagtgccttgccctggcttagttgaaggagaagatggctgttttcacttccccccatagagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggc

SEQ ID NO: 207 - DNA, 307 bp, Homo sapiens
  misc_feature (39)..(52): The "n" positions at 39 and 52 are nucleotide c  according to the corresponding sequence (PRF1 gene) in the Entrez Human Genome Sequence Database.
  misc_feature (39)..(52): The "n" positions at 39 and 52 are nucleotide c according to the corresponding sequence (PRF1 gene) in the Entrez Human Genome Sequence Database.
  misc_feature (246)..(279): Each "n" position in the sequence may contain no nucleotide, or represent at least one nucleotide selected from a, c, g or t.
ggtttacacgctaatcccgattcaccctgtccaaactgnctaagccctccgncattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctnnnnnnnnnnnnnnnnnnnnnnnnnncaaatggnggcctgtcctgacctgtctcaccatgta

SEQ ID NO: 208 - DNA, 887 bp, Homo sapiens
tctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctc

SEQ ID NO: 209 - DNA, 9453 bp, Homo sapiens
gagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaaatttgtgggggggtacgaaaaggcggaaagaaacagtcattcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagtccgaaagaactccgtggatattccagctttcccacaagcactgatcattatgagccagttacttaaccgatctgagacactctcacctcctaaatagggatagatgatactaatttgcaggttgtcattatgataagacaggatctgatcaatatatgtgaattgtttatatttggaacctttttattgagtggaagaagttgttttaaatattctagtcagttctttcctgctcccaggaaagcccggattatgttttaagataagcaaaatgtcttaaaagtaagctgttttactttgaatttttccctaaatgttgattagtgtactagatccattttaatttggaaagtgaagtgctacttatttgaacttcttaaaaatgctaattttaacatctaaagagttaactaagaaaagcttagtaacatgatgtaccaagttgaatatgctgttatccttatttagaatagaaaattggtatttctacgttttatccattctaaggcaggttaaaaaattgtatttccatgactacctatatatttcttgaatttattattgtaaagttgattcatagtcaaacaattaaatgtttaaattaagattaagacactagagaatgatttatttgctgtcctttaattgcagcaaatccttgctgttcccacccatgtcaaaaccgaggtgtatgtatgagtgtgggatttgaccagtataagtgcgattgtacccggacaggattctatggagaaaactgctcaacacgtaagtttgtcctttggttgcctcattaggagtggggctggatacagttatcattgtatagatttgtgtcttataatgagtcccattaatttctccctccctttcttcgtcttcttgcagcggaatttttgacaagaataaaattatttctgaaacccactccaaacacagtgcactacatacttacccacttcaagggattttggaacgttgtgaataacattcccttccttcgaaatgcaattatgagttatgtcttgacatgtaagtacaagtgtctttctaaggtttttagccttctcaaagaaaaatatgctttataatactgtaagcctaatctaaaaacatatttccaagcttatcaaaaagactttaagatagcttttaagtttgccttccatcttaatcgccaaaaatattgacatttagtcccatccagtttatacagtctgctcacaactctgtatacctcttctaacctttactgtttggtcagtttgtggaggtagcatggtccagctgtttattgaatgcccatgggccacagaattgttctgaacatgtagcacccattaaaataaatttggatttggatcagcaagaaaataactttccatgattctaaagtgggtgccatactcagccattcctttcataggcctcttggatagtgagcagatggctacctgaaaaatcaatattgccagattataatgtgcagagtatatgtattttattaaagatgtatttcaagtggccattagactataaagtgtagttgtttaaaaatagattttttttattttggagttacattcaacctcaggtgccactttccacattttacaataaaaataatggttgatttacttaacaaatgagaataaataaaacatttttttctttgaaaatttcagccagatcacatttgattgacagtccaccaacttacaatgctgactatggctacaaaagctgggaagccttctctaacctctcctattatactagagcccttcctcctgtgcctgatgattgcccgactcccttgggtgtcaaaggtgagtaagaagaatccattagagatgtattaactataagacgggctgcattgctgccaaaaaaaaaaattgaccttagactaccatttatttattaacaaaagcagtttttacttttagcatggttatctatgggtattttttaaagtatgagtctatataaactattatgtaaaagcaaatgagcgtcttggtataatgtcttaatattttcaaattatttctttagaaatgaaataattctaattaaaatagataaaatcattcagtaagaagttgttccaccatatcttagaactgttgtttatattatgatcctattcacaattgtaattctcatataaatgaagaattcttggtagattgacagtcaccatctcctttcttgaatacatagatggattcttaccttagctttctcatttttcaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtaagatagagttaatatcttagagttagtaaaattataccaaatcatagtcaagggctaacattaaaggagatatacagatagatagatccaaataacttatccactttttttaaaaagaagtcttatctataaaaaccttaaaggaattttccatttacttcactggtctagtaaaattatacacacacacagacatgcacacacatatataaacattcacacacatacatatgtacaggtattgttatttgtaatttgacccttgtattttttagtttaaaatgttagtactgcaaaatgttatgtcctcaaaaacacattgtaccatgattatgccgctttcaatattgtaaagtgaggtttttgccgcattattattttttggatttcaatagcatagcttcaagttattcgtaagaattttttataaataatacatttttatacttttttataattaccatatcatcatagtgaagtatataatatatatgatataagctcaatatagtatattaattccgttaaacacaaagacatatcagtttgtagctttggtggataaacaaattaatttagcaattcatggctatgaaaaatgtatattttatttaaaaattttaaagaaagctaaatgatcaaattatttaatgatgaattatatgatagacactttatataagaaaaacttcaacagcaacaaattaaaattttttcatcattttctaggtggacttaaatcatatttacggtgaaactctggctagacagcgtaaactgcgccttttcaaggatggaaaaatgaaatatcaggtatgcttcctttgactattaagacttagttattaccgcttatacccatattttaaaatccctaaaaatgtgttccttaactttttaactgatgtttatttatttatttatttttttagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggtaaacaagaaaatgatttatataaaaccctcttccccagggaaaattagtgtgctatctttgttatgttttgagtaaatgacaagatgtggtaaatgaaaactcacacattctatatacattaaatatgtaagcatgactgataaaatagctatcttttgatactgacaaggaagaaaacagaaatgaaggaatagcaaattttaaaaattgcattccagttgcttgaaagcttgtgatcagatgcaataaatgtttttattatttattttgtgcaaataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggtaagcattattattgaaaaccaaaacaaaagactagtcagtaactttagaatttctgccacggaaattatttttcttaaacttactaaaagagtagttagttatattgctagtaaaattattttattgatataagaagcctaactttgtttgaaaagtctaaacttttagtctagtctacagttgtcagacaaatagcaaattgtacccctaccttaaaaatattttcaaaaagtatctataatcttataggaataaatattttaggcttgaatactagtgttatttttgaaatgtaaaaaggcaaattagttctaggctggtgtcccattgaattttaagcagagctcctgttgaaatgtaggtaagcatctttccagcaaataaaaattgtctccgctgggagtttcagttttacctgatttgtacctaaggcaagctgaatacaaacagtaaatatgcctaaaattcttgttttacaactaattttactttccacaggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggtaagaaacagtttctaaacttcttcgttttttgtttgtttgtttgtttttgttgtttttggttttcttttcgagatggagccgccctctgtcacccaggctggagtgcagtggcgccatctcggctcactgcaacctccgcctcctgggttcaagcaattctcctgcctcaacttcctgagtagctgggactacaggctcacgtcgcacgcatggataattttttgtattttcagtatagacggggtttcaccgtgttagccaggctggtctcaaactcctgacctagtgatccgccggcttcggcctcccgaagtgctgggattacaggcgtgagccaccgcgcctggcccctaaacttcttaaaagaatcaggggtcaaatggaaacagagaagttggcagcaaattgagcaaaagaatcaaactgttttttattttgtgaagtttgacattggttgtatctctgtcttcatcgccttcacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaaaaaaaaaaaaaatcgatgtcgactcgagtc

SEQ ID NO: 210 - DNA, 7350 bp, Homo sapiens
tgtgcgtcgcgctctcgccctcctcttcccgctgcagtgtctatggagcgaggctacgtttcattgccgccctggcttaacccttccggcgcctaaaaggacggccggccggccggtcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggattcggccaaggaatcttccgctcgctccggagcgaggagcctgtaaagaggctgttcccagctccagctctaacctcgcctacaccttgggcgggcccaatgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttccttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggtttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaaaatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatat

SEQ ID NO: 211 - DNA, 1559 bp, Homo sapiens
agcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattg

SEQ ID NO: 212 - DNA, 244 bp, Homo sapiens
  misc_feature (59)..(153): The "n" positions at 59, 60, 63, 64, 65, 66, 109, 129 and 153 are nucleotides t, t, g, g, t, t, t, t and a, respectively, according to the corresponding sequence (FECH gene) in the Entrez Human Genbome Sequence Database.
  misc_feature (168)..(206): Each "n" position in the sequence may contain no nucleotide, or represent at least one nucleotide selected from a, c, g or t.
gagattcataaatcttctatattgagaattggctatgttaataaatattacaacatcannaannnnttagctaagtttgattcatgctgtctgttaaatcaaaactganctaaatcagaattattaaangtgaggagcttttttaatacaggnaaagaaacatgtcannnnnnnnnnnnnnnnnnnnnnnnnnnnnnnnnnnnnnnctcatgagtagcatccacatttttaaaatttcaaattg

SEQ ID NO: 213 - DNA, 5201 bp, Homo sapiens
cgtagccatcgagaacatcctcagctttatgtcctacgacgaaattagccagctccgcctggtttgtaaaagaatggacttggtctgccagagaatgttgaatcagggatttctgaaagtggagaggtaccataatctatgtcagaaacaagttaaagcacaactcccaaggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttagtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaacatttgtcagccaaggtcatccataaaagtccccgtctggaactcattttctcagcacttctcatttttataatcatagtatttagccatattagcatatctttagaggaggcctggtggaatacccggggcctctactagtctgtttttccggtcataggaagacttttttttttacgtatcaaagtatgtgtttacagatttacagagtgtgatccgtatgcatcaaagggatacagccccagactgtttctttaatggtcattcatgaactattaaaaatttcctgaatttctttttaaactacatctagatagcctaaacatctatgtagtcttccattagttaacatgtgtatagggctttcataataagtagtcacactgttacaaggtaaattttctattacaaaatccaaatttctattgcatacacttataatcatctattcataaagctaattcattgtacttgttaatgcatgaatgttccatgcagtaggagaataaagcactacagttcggttgttcaaatcttaaatcttaggctatttagctaaaacatgttaggatattgccttcaccacttgttaggacagttatttgatagccattatgcttacctatggatagcataatggtatttaaggttcaacaaaccgcagattattatcatcagctagaactgacatatgttacaagaaaactgtaaattaacctcctgagagaaccattctgccctgcattttaagtcaggtatttaaatactgcgtgttgttaatattgcgttgtcttagtgcaacatttcttaaagtattcccgttatcttccttggctgtttttcagaggagacgtctccatgttaatgggtccttcccacatagaaatgtattctggtacagcgctgcacacatggatagcaatgtgaaaaggcatgcctaagagacagaaacggctgaccttaccccaccccagccggatcctctgcttatctcccacatgcacttggcttaactggttttcacagattctgaggttatagaacctgttgtttttcaaactcctgtacagagcctggaaataatggagcaaacgcaaatgtattgagagtcattatactttaaaatagttttaaagactattggggtaccatcaggtcaaaagccactgatttgggaagcaatttttttgcaaaacactttttttggagtactgaactttacaggggcttgccttaatctctatttagtagtttcaagatgtatgcgcaattattctacgtgttaaaaatgttaaaatattctatgtagccccaaaggtgggtaaaacagtataagtaatgcctaaattaataagctaaaaggtgtcactacagctggatttttgagagaaaatggacataaaactaggctatgtgtaataaaaataatggcaccttaagattgcactattttacgcattattttatatgccatttcatagcctgcactttaatctccaaagaaacgatgtatgatgtcccacttgttccttattcttaataaactttttcctgagacagggcacttaattccattttactgtactgaattagtttcttggaggtagattcatttcttgagttctctgtttccttagccataatattttctaggatccgggaactccctgtattgtctatttccaacattatataattttaatttaatgtaatgtaaatctcatacttggtgatcagcacattcttatatcctgctctagcaatgagtacccatttgttacacttaccaaactctctaaaaacatatactgtgagtaagatttgaagccaggaataaaaggcagtctgaaagaaaacgtcctatacgatgcagttgtttggaaatggctgatttctgatatgaaacccaacttgatacactgtttggttctttgacttgggatctatctgaattgctttcactagtacacaaaaggttaagttaaaactactttaaacttgtatagcctgccatctgaggtgaattattttcaaaaaatactaaatctatgaactgagactagcaattagttggctgctccctaccatgattttacttttaatagcaatacagttatattggtgataaatatgacaggcttaagtactgctgtccttttgcatcttcctaagcatcttggttaaatttctgaagtttaaaaattagatccagatttcttctgttgtgtctgaagagaaccatgacatttagaagtatattggtaatctattaggtccattggcaaagtatattggtccatattcaaacctattccaaaaggttagaagtgtttaagattcctttattgtggtaccatgtctgtttacctatgcttatgagcaacaataaattactagtttaccttctggaattttaattgttataaccgaatcaattattggaaagtgaaaaacacctcccggtcacacaacagggtacgtaaataaatgtgttgttaccagt

SEQ ID NO: 214 - DNA, 3062 bp, Homo sapiens
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 215 - DNA, 1646 bp, Homo sapiens
tagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgagacgggaccagaagagctgaatacttctgtctaccaccccataaatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaactatctctaccatagccatgtggtgcaatgcaaactgctgtaattcaagagaggaaatttcctcacctcccaattctgtgtaatcaagaatacctccttatgaaaataattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 216 - DNA, 821 bp, Homo sapiens
ggtactcaacactgagcagatctgttctttgagctaaaaaccatgtgctgtaccaagagtttgctcctggctgctttgatgtcagtgctgctactccacctctgcggcgaatcagaagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcacctggacttgtccaattaatgaagttgattcatattgcatcatagtttgctttgtttaagcatcacattaaagtgaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaatgtcattataaaataagaaaaatattaataagacaaatattgaaaataaagaaacaaaaagtgcttctgttaaaaaaaaa

SEQ ID NO: 217 - DNA, 3460 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgcagtcgatagtgt

SEQ ID NO: 218 - DNA, 1262 bp, Homo sapiens
ctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtc

SEQ ID NO: 219 - DNA, 2418 bp, Homo sapiens
gcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagccttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaaaaaaaaaa

SEQ ID NO: 220 - DNA, 2193 bp, Homo sapiens
atggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaggaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagataaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaaagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctctgcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaa

SEQ ID NO: 221 - DNA, 767 bp, Homo sapiens
  misc_feature (6)..(765): Each "n" position in this sequence may either represent at least one nucleotide selected from a, g, t or c,  or contain no nucleotide.
  misc_feature (71)..(442): The "n" residues at positions 71, 105, 241, 242, 333, 400 and 442 are a, t, t, t, t, c and c, respectively, according to the corresponding sequence (ATP6V1H gene) in the Entrez Human Genome Sequence Database.
ttgatngttctccccncancaagangtgggccgnatatggatggcagtcagtgtgctaaaacatttataantctgatgactcatatctgcaaagaacagaccgtncagtatatactaactatggtggatgatatgctgcaggaaaatcatcagcgtgttagcattttctttgactatgcaagatgtagcaagaacactgcgtggccctactttctgccaatgttgaatcgccaggatcccnncactgttcatatggcagcaagaattattgccaagttagcagcttggggaaaagaactgatggaaggcagtgacttaaattactatttcaantggataaaaactcagctgagttcacagagttcgcagtatgtgcagtgcgtggccgggtgtttggagntgatgctccgggtcaatgagtaccctttggttgggtgggagnagatggggtaaattggataatggggngnnggngtacaagtgtggttncagctccagntcaaatnatttnncaatntggtcccggcatcagccccaaatntgngacaacggantggatccattggcttnccggtgctgccaannngnttncccgcnccccccnnnnnnnnnncccnncnnngccnnnnncnnnncncccnngccnnnccnnnnnnnccnntnnnnccnnnnnnnncnnnncnncnnnnnnnncnnnnnnnnnnnnnnnnnncnnnnnnnnnnnnnnnnnnncnnnnnnnnnnnncnnnnnnnncncnnnnnnnncc

SEQ ID NO: 222 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 223 - DNA, 1092 bp, Homo sapiens
ccctgagcagaaggctctggtgattggtggagaggcttgtatgtggggagaatatgtggacaacacaaacctggtccccaggctctgctaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgcctatgaacgtttgtcacacttccgctgtgagttgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaact

SEQ ID NO: 224 - DNA, 2029 bp, Homo sapiens
gaattcgggcccgtcggctttcttcaaccctctcttcccggagcgcccccaatccacgagtggcagccgcgggactgtcgcgtcggcgcccgacgcggagtcagcaggggcgaaaagcggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttcaatgtttgaatataatgtggaggtgtttacctgagggcctctctatctccccgaattc

SEQ ID NO: 225 - DNA, 806 bp, Homo sapiens
  misc_feature (2)..(804): Each "n" position in this sequence may either represent at least one nucleotide selected from a, g, t or c,  or contain no nucleotide.
  misc_feature (18)..(372): The "n" residues at positions 18, 130, 135, 174, 185, 221, 287, 293, 301, 310, 313, 356 and 372 are t, t, t, t, c, c, a, t, t, t, t, c and t, respectively, according to the corresponding sequence (RASSF2 gene) in the Entrez Human Genome Sequence Database.
  misc_feature (34)..(54): No residue exists at n positions 34 and 54 according to the corresponding sequence (RASSF2 gene) in the Entrez Human Genome Sequence Database.
tnnttactccactgactncttgttgagatttttntgcatggaaaacagatattntgggggggggcattatatgctaccgatattaggataaaatgtgtttacctagaggtttctaggagagagtactgtnctctnctggtgagggaagagaggattgtgaaaatatttctcctngaagcatcagnatgtctcagatcaaaatcttgacccgaggcctcagnatttttcttgaagatgggtgactaatatccagaaatcctcttgcctcaactcaactccaagttgangtccanccagcctngtgcacgtnctncaccaatacgtacagggaagatatctttgggtgctttttcagnctctccccaagataanccccaccccnnnncatntangtcaacaccccccctctcatgtnaacanagggatagnttcaattggcttnacagtggggaagggggggggnnnnnnnnnnnntnnnnnnnnnnnnnnnnnnnnncnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnccnccnnnnnnnnnnnnnnnncnnnnnnnnnnnnnnnannnnccnnnnnnnnnnnnnnnnnnnnnnnnnnnnnnnnnnaannnnnnnnnnnnnnnnncnnnnncaacnnnnnnnnnnnnnnnnnnnnnnnnnnnnnnnnaa

SEQ ID NO: 226 - DNA, 1145 bp, Homo sapiens
aggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtccagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatattttatatttttaagaagtaccacttgaaacattttatgtattagttttgaaataataatggaaagtggctatgcagtttgaatatcctttgtttcagagccagatcatttcttggaaagtgtaggcttacctcaaataaatggctaactttatacatatttttaaagaaatatttatattgtatttatataatgtataaatggtttttataccaataaatggcattttaaa

SEQ ID NO: 227 - DNA, 5704 bp, Homo sapiens
gagtcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagc

SEQ ID NO: 228 - DNA, 2369 bp, Homo sapiens
ctcggatcagtctggcagagagaggaggttgtctgggacagactgctcctgacagaaggatgtcccagctgagcctgtcctggctgggcctctgccgagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtgtcctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcgcgtgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatactgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatt

SEQ ID NO: 229 - DNA, 2113 bp, Homo sapiens
gtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 230 - DNA, 2047 bp, Homo sapiens
gtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcaggccgctgcagtccatcaacgagtgggccgcgcagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaagcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattt

SEQ ID NO: 231 - DNA, 229 bp, Homo sapiens
ggacctggggaaccgaacaccgggaacctgccttccccttccagcccgggagcatcacagaggtgtgcatcacctttgaccaggctgacctgaccatcaagctgccagacggacatgaattcaagttccccaaccgcctcaacatggaggccatcaactacatggcggcggatggagacttcaagattaaagtgcgtggcctttgagtgaagccagccagcctgtagcc

SEQ ID NO: 232 - DNA, 1349 bp, Homo sapiens
gagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccgactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctactttccgtccatgtacctgcaaaagtcggggcaagacgtgtcccaggcccaacgccagatcaagcggggggcgccgccccgcaggtcgtccatccgcaacgcgcacagcatccatcagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgg

SEQ ID NO: 233 - DNA, 400 bp, Homo sapiens
  misc_feature (26)..(26): The "n" position at 26 contains no base according to the corresponding sequence (CHN2 gene) in the Entrez Human Genome Sequence Database.
atttgttcctccttgacaaaagtagnctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgtt

SEQ ID NO: 234 - DNA, 3840 bp, Homo sapiens
ggccttccccctgcgaggatcgccgttggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccagcggagacgcggccgccctgggcgggcgcgggcggcgggcggcggtgagggcggcctgcggggcggcgcccgggggccgggccgagccgggcctgagccgggcccggaccgagctgggagaggggctccggcccgatcgttcgcttggcgcaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatccgctgagcagcgggatcaatggcagcttcttggtgcgtgagagtgagagcagtcctagccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctagtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctagagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgaccgttcccaggtgtatgagctgctagagaaggactaccgcatgaagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgactaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgtctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagcctggaaaggcagtgccttagggacccctgctgcagctgagccagtgacccccaccagcaaagcaggctcaggtgcaccaaggggcaccagcaagggccccgccgaggagtccagagtgaggaggcacaagcactcctctgagtcgccagggagggacaaggggaaattgtccaagctcaaacctgccccgccgcccccaccagcagcctctgcagggaaggctggaggaaagccctcgcagaggcccggccaggaggctgccggggaggcagtcttgggcgcaaagacaaaagccacgagtctggttgatgctgtgaacagtgacgctgccaagcccagccagccggcagagggcctcaaaaagcccgtgctcccggccactccaaagccacaccccgccaagccgtcggggacccccatcagcccagcccccgttcccctttccacgttgccatcagcatcctcggccttggcaggggaccagccgtcttccactgccttcatccctctcatatcaacccgagtgtctcttcggaaaacccgccagcctccagagcgggccagcggcgccatcaccaagggcgtggtcttggacagcaccgaggcgctgtgcctcgccatctctgggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgtcagcaggcagtggtccggcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccatgacagtggctgag

SEQ ID NO: 235 - DNA, 1839 bp, Homo sapiens
agcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaaaaaaaaaaa

SEQ ID NO: 236 - DNA, 2623 bp, Homo sapiens
tcttgactactgggatatctgagctgatctgtgtgttagaaatattggatgtcttaaaagatttgtaacaagatataagtacataaggaaagtaataaaacaggagagcttacatagaaagcatcttaaagagtaaataggagaaagggagttttctttggcattagacaagagtcatagccaggaaagttactcttgataaaatttttgttataatgacttcctcattaccttactttatttttaatccccctagtatgtttgtgctactgaaaggagccactaaggagcagtcttttaagattggtcaggaaattgccgaagctgtgactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggggatttattgcggcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcctgttctcactcatagatccataaagctaccagcccctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcaacgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatataacaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaa

SEQ ID NO: 237 - DNA, 259 bp, Homo sapiens
ccaacagtactgccagcttgacttcttcaatgaccaccaccgagaccacctcacacagtactcccagcttgacttcttcaatgaccgccaccgagaccacctcacacagtactcccagcttcacttcttccatcaccaccaccgagaccacctccaacagtactgccagcttgacttcttccatcaccaccaccgagaccacctccaacagtactgccagcttgacttcttcaatgaccaccaccgagaccacctcaca

SEQ ID NO: 238 - DNA, 5247 bp, Homo sapiens
ttccggcgggggaggcgccgggaagtcgatggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgccgcagcacaaggctgcccaggtcgccaaggagaaaaagaagaaaaagaaaaagaagaaggcagaaaatgcagaaggacagacgcctgccattgggccggatggcgagcctctagacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagaga

SEQ ID NO: 239 - DNA, 2066 bp, Homo sapiens
agcatggatatatagctccaccattcactctagtttgtttttttttttttttaaataaaagtcagtttgtacaagttccctcacttctgtatggcatcatgtacttgagctgcagggaatcatgcatttcatacagttatctgcataagggtgtgtgagagagagagagagagagtgtgtgtgtgtgtgtgtgtgagagggtgtgagtgtgtgagagagtgtgtgtgtgtgtgaatgtgtgtgtggacacatacattttcaaagggagactggtaatgactgtgaatatgccctctgctcatgcatccccagtttcaggaagcaggacctgggtgaacacacttgcagagagcctcactggggttctttcctggctgctgtcttgtctgctgatggaaaggtgtctggcttcgggccctgaccttgatgagagctcttggcacatgctggaggcctggaatgtcatcccacagttccactgtcatcagttctcagccaaccccactgttgccttttcagccaatttcatggtgtttattctggtgtcagtctcctcaccggagcgtgggcactcaagggcatcgagcgagtctgtcttgtttgctgctgcagccccagcacagagtccgatgccttgctctgcccctgctcttggaaggcctggctgaggcagtttccctgtctcttcccatttcaagggcacccactcatcaggttcctcgaggaagaaacttcacgcatctcaggcctgccttccctccatctgtccccaaacctcccattccttgacccctgtgcctaagtactcatcacttccacttagaacccacggctgcacatcagcaaactgagtacatgcttttgttgatccaaatgtgctgacagtgcagtggcactgcttactgaagtctgctgtctgcaggctgtcacacaggattgtctgtaaatttatcagaacacttccaggaaggcattactgtccccattctacagacaagaaaactggtgcttggagaggtagggaacttgcccaggatcatgcagtgagcagagtctttctggccccagagctgattctgtctcagcttctgaaagcagctcacatagccaggcacatgctgtggcagggttctccctgccctactgttttactgcttctcaggaggccctgtggggcgggtgtctacaacgtgtacatttgtaggagtgtcccaggaggagcattttgttccacttttgctctactgctggctcgctctgtgtgtcttaggacacatctcttaacctctctgggctcaaccactgcacagtgaaggctctggattgataatctgtgaatgctgtgttctaattaaatagtgggtttcttggccttgggtattctgtgtctcatttttgtctttacttgttggctccacaaagcaaaacctattgtcagtaattcttactaactttatattgatgttgactgtgtagaccaattctagctacgttagccttttgttcatataaaatgaacaactgacacgtaattgttactgttttccatagtgcactgtgtcatcctgactccacgtatagagtgttcactgtgtgccagggctgctctcggataaaacctattctgttgaagtcctggctggccctaactttttaagtttaacaaggttgagaacacaagtgactttgattagcattgtcctaatctggtttatcagtagcaggggaatttataagcagttaccaaaatgcatccaaaataagatggcttaatggctaggcagaggggagagatgtgatgaagtcagtacagcagaatggtaacaagtgagcatctccctaatgggaatgggacattcctggtagagctgggagaaaaaatgaccaaagctactgggaaattctgcagagataattgtcccattactttttaattaattaaaactaattaattaactattttttttttgagacggtgtctcgctctgtcacccaggctgaaattgcaccaatgcactcatctgggcaatggaacaagactctgtttaaaaaaaaaaaaaaaaaaa

SEQ ID NO: 240 - DNA, 127 bp, Homo sapiens
ggacttgcttactaaaactacaaaacttcaaattttgtctggggtgctgttttataaacatatgccagatttaaaaattggtttttggtttttcttttttctatgagataaccatgatcataagtct

SEQ ID NO: 241 - DNA, 181 bp, Homo sapiens
tacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcg

SEQ ID NO: 242 - DNA, 603 bp, Homo sapiens
tttggcagagatttagatctcgctatcttctctggctggctcaacatggaaggatcccaattttgaaagaaaaagcatgtgagacacagaacaagcgagagagtgagggcccggcatgcccccaagtcccccccaccctgcttgccgcgaggctccccagtactccccacggcagccatcgctctctcgccaaacaaaacagaagcccccaaacagaacaaaatggaaaaaaaaaagatttttcacagatgaagaagttcacattcattcgattcattgagcctgcggagagggaagagataggaattggtcactacggggagggaagggtgggagactagggggcggaaaagaggaggggctggaacaccgtggggggggccaggaagcccctcccaaacctgcgctggctcaggctggaaggacgtgcttgttaactgtctagccaggtgctcgcgggactcgctgaagtcacgctgctccctgatggagaaggagggaggcgctggctggagtcggggctgggggtgggaaggggtgagggaaaggttggggggggacgcatcaatcaacgttgctgctgtccaaggtgtagcactgaaa

SEQ ID NO: 243 - DNA, 2269 bp, Homo sapiens
ccgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgcctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccgggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattataataatcttataattgttctcagaatcccttaacagttgtatttaacagaaattgtatattgtaatttaaaataattatataactgtatttgaaataagaattc

SEQ ID NO: 244 - DNA, 73 bp, Homo sapiens
caggaggagacaagagttgtgcgcgatggtgagtcctgttacaagtcgaggacgccgcgaatttagtagaggt

SEQ ID NO: 245 - DNA, 3183 bp, Homo sapiens
actcgctccctcccccggatcccgactgggaagggggcggaggggacgacgtccgcgagaatgcaaaccacacaaaaccccgaagtggccgtccccgccgggctcgaacctctgcgaacacccgctgggctgctgctcccccttctttctgtctttcctttattttttggaagtgacaagggcccatctgcgcccagacccccgttcgccctctggcccgcgggcgaagaggggagagggagctgcccgcgcagtccccgggctcgggccattcgaccgggtggggggtgacggggggtcgcggaggcggccaggctaggaaaggggagaagagccgaagacagcacagacttgagcggcggcgccgcgggaggcactagagcgggcccgagcgaaacataaacaaacgcacgcacacccgagctcgggctctgaccgcggctcggctgcgccagctccggccgctgcccgctttaaaggcgcggccgcccctcccccgggcgcccctcccccttctccccgccccgccgcctagcccgggagggacctgcggctgggcggcggggggagggggctgccccgcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgctgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttcc

SEQ ID NO: 246 - DNA, 886 bp, Homo sapiens
  misc_feature (13)..(882): Each "n" position in this sequence may either represent at least one nucleotide selected from a, g, t or c,  or contain no nucleotide.
  misc_feature (94)..(624): The n residues at postions 94, 299, 312, 360, 388, 430, 579, 581, 613 and 620 are t, a, a, c, c, c, a, g, a and c, respectively, accoridng to the corresponding sequence (PRO2389 genein the Entrez Human Genome Sequence Database. No residue exists at n
ccccccccccttnctttgtcgccnantcagnngnactgcctatccggggccacatgaagcttgtggagatcctgcctctcataccacagcctgncctaccctaaagaccagacatgacagcagacataatccccaccccaggagggtgctgaggaaacacccttacccatgcccctcccctagagacctcaggaagaaaggccaggacacctgtcctgtgattggccagttgaatcctcaacgtgaagacctggcaggcctggctgacaggtctgttcagatgtggcctcaggtatctnctctaggatccancccctaacattcaaacatgattaaaaacacccaggacacttctcttgntggcagaggccacaccccagataatggnagtcctgtcaaactctggccagagatagggacccaagctgantgggtgtgagcacgtaaggagaccactctgccccatggggagaatcttccagggctcagctgagggtcagagcccaggtttatgttattccccatcaaaatgccagtgattcctccaaacattccccacaagggagacagggaggaggngncagagagtttattcaagagggttcaccctttnttggggnttgnagggtgggctcttccttgggggtggaggaaaaggggttgtngagggnttgggggggaactgngggnagggggngnttgggaaaattcccccaagattcttggcatgttnanctnggnaggttctccagccntgggnggnaatttccaaaaggacggaggttncccntcccccgaattttttgnaaattttnttttncaaaggggngccatttannttaacnacnaaagggctggggttnggncaantttttcaaaaantccc

SEQ ID NO: 247 - DNA, 177 bp, Homo sapiens
  misc_feature (1)..(141): Each "n" position in this sequence may either represent at least one nucleotide selected from a, c, g, or t, or contain no nucleotide.
nnntcccagggggtgtgggacattggggctcccgtggacagtctcagccctcccagcaccagcacctgcatgtaccctagaacctcaggcacagcacaccgattggtgtccggctggtgacttgnnnnnnnnnnnnnnnnntttcccgtgggtccctggtttggtgtcctggcccca

SEQ ID NO: 248 - DNA, 171 bp, Homo sapiens
tagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgc

SEQ ID NO: 249 - DNA, 64 bp, Homo sapiens
tatattgagatgacactctagcaatttatatagatagctactcttacaggaaatactgtaccaa

SEQ ID NO: 250 - DNA, 48 bp, Homo sapiens
catgagcagtggtgttctaatgaagttatgacatctgtcctaattagt

SEQ ID NO: 251 - DNA, 251 bp, Homo sapiens
cgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttga

SEQ ID NO: 252 - DNA, 43 bp, Homo sapiens
acctcataattcttaacacctggcatttccatttctaaagatg

SEQ ID NO: 253 - DNA, 83 bp, Homo sapiens
cccagcctccaggcccccaactccgcccagcctctccccgctctggatcctgcactctaacactcgactctgctgctcatggg

SEQ ID NO: 254 - DNA, 30 bp, Homo sapiens
aaaaaaaatgttttactatgtggccttcca

SEQ ID NO: 255 - DNA, 957 bp, Homo sapiens
  misc_feature (15)..(957): Each "n" position in this sequence may either represent at least one nucleotide selected from a, g, t or c,  or contain no nucleotide.
cctttgttgttgccntgttaagaaagttgcattctgctgtttgcttggacaccgtaccactgaacaaaactccacagagtcttgctatccgccagcaggggtggccgccaaactcacgggaaattangcggcatcaggggntcaacatccacaacaggggggtgtttttttttcatggcctgtggntggtnttcaatttcttcagnagnctcagtaactcttttcangggcaaatttgngctctgcactcaccgaaaactggcaatttgaaacacacnctccttacaagtaaatggaacgntcttgatcagnacactggtatcaantcacncntcnataggacnctcagatncnncggggaaagnacagcctgcntatttaggggggtattnttttgatctnaccggttanccnagtagtacgtggnngcccnnattcaaattggtntnnccagttgactgnaanngtnggnagntcagntcttnggntcanctttnggggnttccatggngnntttttcttgnccagntttngggggggnttttnggncagncctttttttttcccntttgggnnnnntnccantttggnnttcncagttnttcnnnnnnnnnnnnnnnnnnnnnnnnnnnnnnnnntntnnnnnnnnnnnnnnnnnnnncnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnn

SEQ ID NO: 256 - DNA, 762 bp, Homo sapiens
atgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaactatacttgaacaaaagggtcagaggacctgtatttaagcaaatactaagcaaaaagtggggcagag

SEQ ID NO: 257 - DNA, 326 bp, Homo sapiens
  misc_feature (29)..(296): Each "n" position in this sequence may either represent at least one nucleotide selected from a, g, t or c,  or contain no nucleotide.
attcctgcacggaagacaagagagtagcnnnnnnnnnnnnnnnnnnnnntaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttnnaaaaaaaaaaaaaatttatgtccttcttatttatttctaggatgaggggannnnnnnnnnnnnnntttcttatgtgactctctttgaaaatgtgc

SEQ ID NO: 258 - DNA, 73 bp, Homo sapiens
tactgaccactgttgcttgttgctcactgtgctgcttttccatgagctcttggaggcaccaagaaataaactc

SEQ ID NO: 259 - DNA, 3637 bp, Homo sapiens
cagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgttctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactcaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggtaagtcccttgacctttccaggcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctgggtgaaggaaggtacaggcaggatgatccagggattgggctg

SEQ ID NO: 260 - DNA, 326 bp, Homo sapiens
  misc_feature (130)..(296): Each "n" position in this sequence may either represent at least one nucleotide selected from a, g, t or c,  or contain no nucleotide.
atttatcacacttctgtgagacccccacacctcagttcccttggcctcagaattcacaaaatttccacaaaatctgtccaaaggaggctggcaggtatggaagggtttgtggctgggggcaggagggccnnannnnnnnnnnnnnnnnnttnaccccttagcctccctgnaaantntttttntgccagggngnttgaaagttttnnnnnnnnnnnnnnnnnnnnnnnnnnnnnnnnnnnnnnnnnnnnnnnntttgatgtttgtggcctcagaattgatcattttcccnncccccnccccacacttgttccagctctttgaaatag

SEQ ID NO: 261 - DNA, 25 bp, Homo sapiens
atgcgaacagcaaaccaataaactg

SEQ ID NO: 262 - DNA, 478 bp, Homo sapiens
cttcaagaccattgtggccaaggagatctgtgctgaccccaagcagaagtgggttcaggattccatggaccacctggacaagcaaacccaaactccgaagacttgaacacccactccacaacccaagaatctgcagctaacttattttcccctagctttccccagacaccttgttttattttattataatgaatttgtttgttgatgtgaaacattatgccttaagtaatgttaattcttatttaagttattgatgttttaagtatctttcatggtactagtgttttttagatacagagacttggggaaattgcttttcctcttttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtaca

SEQ ID NO: 263 - DNA, 105 bp, Homo sapiens
  misc_feature (48)..(48): Each "n" position in this sequence may either represent at least one nucleotide selected from a, g, t or c,  or contain no nucleotide.
actaactgctagaagagaagactctgggttatactggtgcgaggctgnccacagaggatggaaatgtccttaagcgcagccctgagttggagcttcaagtgcttg

SEQ ID NO: 264 - DNA, 108 bp, Homo sapiens
  misc_feature (25)..(25): Each "n" position in this sequence may either represent at least one nucleotide selected from a, g, t or c,  or contain no nucleotide.
aagcccgcctttgctaagctgagtnagctgcactgtgacaagctgcatgtggatcctgagaacttcaagctcctgggtaacgtgatggtgattattctggctactcac

SEQ ID NO: 265 - DNA, 1976 bp, Homo sapiens
aatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcaggttggtatcaaggttataagagaggctcaaggaggcaaatggaaactgggcatgtgtagacagagaagactcttgggtttctgataggcactgactctctgtcccttgggctgttttcctaccctcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgagtccaggagatgcttcacttttctctttttactttctaatcttacattttggttcttttacctacctgctcttctcccacatttttgtcattttactatattttatcatttaatgcttctaaaattttgttatttttttatttaaaaattctgcattttttccttcctcacaatcttgctactctaaattatttaatatcctgtctttctctcccaaccccctcccttcatttttccttctctaacaacaactcaaattatgcataccagctctcacctgctaatttcgcacttagaataatccttttgtctctccacatgggtatgggagaggctccaactcaaagatgagaggcatagaatactgttttagaggctataaatcattttacaataaggaataattggaattttataaattctgtagtaaatggaatggaaaggaaagtgaatatttgattatgaaagactaggcagttacactggaggtggggcagaagtcgttgctaggagacagcccatcatcacactgatttatcaattcaatttgtatctattaatctgtttatagtaattaatttgtatatgctatatacacatacaaaattaaaactaatttggaattaatttgtatatagtattatacagcatatatgtacatatatagactacatgctagttaagtacatagaggatgtgtgtgtatagatatatgttatatgtatgcattcatatatgtacttatttatgctgatgggaataacctggggatcagttttgtctaagatttgggcagaaaaaaatgggtgttggctcagttctcagaagccagtctttatttctctgttaaccatatgcatgtatctgcctacctcttctccgcagctcttgggcaatgtgctggtgtgtgtgctggcccgcaactttggcaaggaattcaccccacaaatgcaggctgcctatcagaaggtggtggctggtgtggctaatgccttggctcacaagtaccattgagatcctggactgtttcctgataaccataagaagaccctatttccctagattctattttctgaacttgggaacacaatgcctacttcaagggtatggcttctgcctaataaagaatgttcagctcaacttcctgattaatttcacttatttcatttttttgtccaggtgtgtaagaaggttcctgaggctctacagatagggagcacttctttattttacaaagagtacatgggaaaagagaaaagcaagggaaccgtacaaggcattaatgggtgacacttctacctccaaagagcagaaattatcaagaactcttgatacaaagataatactggcactgcag

SEQ ID NO: 266 - DNA, 4470 bp, Homo sapiens
cacaaggcttatcagattgacccaacattaagaaagcatcgagaacagttggtcattgaagttggacgaaaactagacaaagctcagatgattcgttttgaggagcgaactggatatttttcctcaactgatttgggtagaactgccagccattactatattaaatacaacaccattgagacctttaatgaactctttgatgctcacaaaacagaaggtgatatctttgccatagtctccaaagctgaagaatttgatcaaattaaggtcagagaagaggaaatagaggagttagataccttattaagcaatttttgtgaactctccactcctggaggtgtagagaatagttatgggaaaataaacatcttacttcaaacttatatcagccgaggagaaatggacagtttctcccttatatcagattctgcatatgttgcacagaatgcagctagaattgtccgtgctctttttgaaattgctctgaggaaacgttggcctaccatgacctacaggctcctgaatcttagtaaagtcattgacaagaggctttggggttgggctagccctttgagacaattttcaatcctaccaccacacatcctaacaagattagaagaaaaaaagcttactgtggataagctgaaagacatgaggaaagatgaaataggtcacattttacatcatgtgaatattggactgaaggtcaaacaatgtgttcatcagattccttctgttatgatggaagcattcattcagcctatcacaaggactgtcctccgagtgacactcagcatctatgctgatttcacttggaatgatcaggtacatgggacagtaggagaaccttggtggatttgggtagaagatcctacaaatgatcatatttatcattcagagtattttctagctctaaaaaaacaagtcattagtaaagaagcccaactactggtatttacaatccctatttttgagcctttgccttcccaatactacatccgagcagtgtctgatagatggttgggtgctgaggcagtatgtattatcaactttcaacatctaattctaccagagagacatcctcctcatacagaattactggatcttcagcctttaccaatcacagctttgggatgtaaagcatatgaagccctgtacaacttcagccactttaaccctgtacagacacaaatatttcatacattgtatcacacggattctaatgtcctacttggagcacctactggatcgggaaagactgttgcagctgaattagccattttcagagtcttcaacaaataccctacttcaaaggcggtatatattgcacccctaaaagccctagtacgtgaaagaatggatgattggaaagttagaatagaagaaaaacttggtaaaaaagttattgaactaacaggggatgtgactcctgatatgaaatccattgccaaggctgaccttatcgtcactacgccagagaagtgggatggagtcagcagaagctggcaaaataggaactatgttcagcaagtcactattctcatcatagatgagatccatctgcttggggaggaaagaggccctgttctagaggtcattgtatctcgaacaaattttatctcatcacacacagaaaagcctgttagaatagttggactatctactgcattagctaatgccagagaccttgctgattggctcaatattaagcagatgggcttgtttaacttccgaccatcagtacgcccagttccactggaagttcacattcaaggctttccaggtcaacattactgtcctcgtatggctagtatgaacaagcctgcatttcaggcaattagaagccattctccagccaaacctgttttgatatttgtctcatcaagacgtcaaactcgtcttactgctttggaattgatcgccttcctggctactgaagaagatccaaagcagtggttaaacatggatgaaagagagatggagaacatcattgcaacagtaagagattccaacctcaagctgacccttgctttcgggataggaatgcatcatgctggactacatgagagggaccgaaaaacagtagaggaactatttgtaaactgtaaagttcaggttcttattgctacaagcacattagcctggggtgtaaactttccagctcatttagtaattattaagggaacagaatactatgatggaaaaacaagacgttatgtggattttcccattacagatgtcctccagatgatggggcgtgctgggaggccgcagttcgatgaccaaggcaaagctgtaattctagttcatgacataaagaaagacttttataaaaaatttctttatgaacctttcccagtagaatcaagtttattaggagtgctctctgaccacttaaatgcagagattgctggtggtacaattacatctaagcaagatgcattggattatatcacctggacttactttttccgacgtcttatcatgaatcccagctattacaatttgggtgatgtgagccatgattctgtgaacaagtttctgtcccatctgattgagaagtccctgattgaattggaactttcctactgtattgaaattggagaggataatcgcagcattgaacctctaacttatggccgaattgcctcctattactatttgaagcatcaaacagttaaaatgttcaaggaccgcttgaagcctgaatgcagtactgaagaactgctttcaattctaagtgatgcagaagaatatacagatttgccagtgagacacaatgaagatcatatgaatagtgaactggcaaaatgtcttcccattgaatcaaatcctcattcatttgacagccctcacaccaaagcacatctcctgctacaggcacatctcagccgagccatgctaccctgcccagattatgacactgataccaaaacagtcttggaccaagctctcagagtatgtcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagaaatggaagccgattatgaagggcccacatgctaggggtcggacctccatcgagtgccttcctgaactgatccatgcctgtggagggaaagaccatgtatttagctccatggtagaaagtgagctacatgctgcaaaaacgaaacaggcatggaatttcttatctcacttgccagtgataaatgttggcataagtgttaaaggctcgtgggatgacttagttgaaggacataatgaactctctgtctcaactctgactgcagacaaacgagatgacaacaaatggatcaaattgcatgctgaccaagagtatgtgcttcaagtgagcttgcagagagtccactttgggttccacaagggaaagccagagagctgtgcagttactcctcgatttcccaaatcaaaagacgaaggatggtttttgatattaggagaagtggataagagagaacttattgctttgaaaagagtaggatatattcgaaatcatcatgttgcttccctttctttttatacccctgaaatacctggaaggtatatctacacattatatttcatgagcgactgctaccttggcctggaccagcagtatgacaatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataaatctgtaaggtggtacacagcgtgtcttgttagcaaaatttatactttgatatgatcacatgtagaagtagcttcaagaatttcttgtagtcataaatgtttaataatatatgatgtaaaattatattatggagcctaatgatgataacaaagaaaacaatatactgatcttagaaaatgtagacatggttaactgggaaataaaatatagagtggcacttcaagacaaaaaaaaaaaaa

SEQ ID NO: 267 - DNA, 79 bp, Homo sapiens
gattgcctaggaaagcaagtcatatggccattgatagttctcatgtaattagttttgctcaccactagtacagatgacc

SEQ ID NO: 268 - DNA, 225 bp, Homo sapiens
  misc_feature (34)..(127): Each "n" position in this sequence may either represent at least one nucleotide selected from a, g, t or c,  or contain no nucleotide.
actggatccaccagctggagtctgagaagttcgnnnnnnnnnnnnnnnnnnaannnnnnaaannnnnnnnnnannnnnnnnnnnnnnncannnnncnnnncnnnnnnnnnnnggangggggcagggnagggccgcgttggaggccgctggaagtgaggatgccgccccggacagtggcacctgggaagcctgggagtgtttgtcccatcggtagcttgaaataaa

SEQ ID NO: 269 - DNA, 980 bp, Homo sapiens
agcaaggctcagcctcaagattcacagcatctcagacgcagcctaggccgcaccaggatgtcggacaccgaggagcaggaatatgaggaggagcagccggaagaggaggctgcggacgaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacc

SEQ ID NO: 270 - DNA, 2572 bp, Homo sapiens
aacagaattagttggcccagctctgcctataagtagctgaatgtcttgaggcaacttcaacgtttccctggaccttagattccttgcctgtaaaacagcatggggccagatgatctctaagggtccttctggctctgaaggcaatgatctggggcatggaacctgtagttagagagctgggaaatgggcagatgtgggctccagggcacccagaattgcaggcttaggagctaacagcaaccaggattctgtagtctagcaatcttgctttacaggtgaggaaactgggcctagaaaggcgaagtgatttttttgcctctctcagctttattcctcttttcctctgaactgtagagtctaaagattcagcacaaagcagttttgtgtagtggatacataagcttttttgttgttatttttctgaattattttgttgactttcaaagttttttttacataaacagtaaatgctcgttataaaaatttccattaatacaggaagtgaaaaaagtaaaaaactgcaaattgctgttatcctcccacccttaccccctaggtccccagaggtgtctctgttaacagttcagcgtgtatccatcctgactcctccaataaatgcagaaacttgtatgtctctccccgacaactggattatcatatacattattcaagcataggctttagactcagacatatctacatctaatcccagcttatagctaattatttgagtgaccttggccaagttgttcatccagttttagtctcaatctccccatgtgtaaaatgaaaataataatagtatctacctggcctggcgtggcggcttatgcctataatcccagccctttggaagaccgaggctagtggatcccttgagctcaggagttcaagaccaacctgggcaatttagcaagacctcatctctactgaaaaacaaaaaacaaaaaaactcccccaaaattagccaagtgtgctggtgtgcacctgtagtcccagctactcggaaggctgaggtgggagaatcgcttgagccaggaaagacgaggctgcagtgagctgtgattgcaccactgcactgcaacctgagcaacagagcgataccttgtttctgttaaaacaaacaaacaaacaaaatagtatctaccttataggatcatggtgaagatttaatgagattttatatgaatagcacttaacagttcctggtactgatagtagtaagcactacacacacacacacacacacacacacacacacacacagagcacagaatgagttagaggtaaagtgaaaactaaaccccaagttttctgaccctcagtctcctcgactttctaccacatctctctgcttctctcctaggtgcctaggcatgggttcagtgctcactacttgttgaatgaatgactgaggttgtgtgtaagggggtagatctagggatctgaggtctgtggagttcctgggatgcctgctctggaaaatggaggctttcatcctgtgagttgggagggtgtggggcagtgtgggttggctggaccagctgttgcttcagagctccatgcctggagagttgggcctctaggcagagctgagggcccagagtggctctcagcttaaaggatcttggcttagaaggaatgtgcagtgggctgcctctgctcgggaggggctaaaaaaagcctcaccctcccctgggctttgtgtgaggcttatcaactgctcaagtcagctcatctctctggctgctccggcatatttgagaaggtctgtttccctggtccttctgggtttccaccaattggcaagaagggatcagcctgtcctagaggtgaagagagagctgtggcatgaaggggagggggctggtggccccaaacctggtgacaatacacagttgtcagctgtaccctgctggcgtttcttccttttatagtcagcagcagttgctcttgctttcacccagcccctctgtggggctcctgcccaggataaaagggaagggaggcagcccaggctcctatctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaaggtaagtgaggctcagccattgggatagaggtggggatgacattgagagtccttttgctctggagcttagcgatctactttatgtgggctggactgggatgaggactagggtgtccatgccccagatcgcagtcccatggggcagtggagtgggtgttggggctgatgagggggagattgagtcataaaccttttccgtcaagaatgaggtgctgctttgagggagccctgtcctgctaccctagatttgtgcagctaagttgggaatggggggaggtacaaccaaccatccatccacccttttataaggcattaatgaggaccaccatagcaaagtaaa

SEQ ID NO: 271 - DNA, 1487 bp, Homo sapiens
caaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgctttcaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttctttttttttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttaaaaaaaaaaaaaaaaaaa

SEQ ID NO: 272 - DNA, 51 bp, Homo sapiens
ccactctcctgccaacccttgttctacaatctaaaccaaacatgtgctagg

SEQ ID NO: 273 - DNA, 273 bp, Homo sapiens
gtgtatctttaggtgcaatcacagcagtcctctcatctctcacccttctttttcaaccctgagccaccgtaattgagctttcctttctgttccttgtggctaagacagtaagccagtgtgagacacaggttcctcccttgggaagtcagagctgctgccctgggtcctgcagagaaacctggccttcagcagacctgtttctctgttgtagacacagaatgacttccgtttgcttttagaccttcattctagtcccctaatgaatgtataatg

SEQ ID NO: 274 - DNA, 159 bp, Homo sapiens
aggagtcaagttgaatggtttgggatttgttttgctaccttcctagacaggctgatggcaagcctctcccggcgattagcagacaagtcaccttaggaggggcaaggagaggaggacagtgcgggggccaagggtggacaggccggagtcaaagtaact

SEQ ID NO: 275 - DNA, 17488 bp, Homo sapiens
  misc_feature (873)..(17196): Each "n" position in this sequence may either represent at least one nucleotide selected from a, g, t or c,  or contain no nucleotide.
  misc_feature (16993)..(17196): The "n" residues at positions 16993, 17103, 17113 and 17196 are c according to the corresponding sequence (C4A gene) in the Entrez Human Genome Sequence Database.
ggtcaacggwtcagaatcgtccagctgggcttcgacttggatgcccatggaattatcttcactgaggactacaggaccagagtatgtgactgtgtgcktcaggggtgctggggggagggcacaggttgggggagacagggaacttgggaaacagaaataaaaacaaaagaaagawtttccctgcccccacatcccatggagagggcacagggccctggtaaatagtaatatgagggagagagacaggagggaaagagggaggagtgagagggtaaagagggggggagaggagggggaggaggaggaaggaaggagggggaggaggagggggggaggaagagggggaggaggatgaagaggaggaggaagaagaagggtatgagaggtggaaggatctgagcaagaggtaagacaggaagagaaatsctttcctgggggtggaggttggtagagagtgagggtggggatggaccatgtctctcatctctgcttgtaggtcctcaaggcctktgatggccgaccgtatkctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttgttaataaaatgacccaagtttgtattcctccccacaagagaggaggcctatcttacctgggccttagaaagagccctgaaatagaattcagttcttggtggcttatnaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtcaaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctsctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgnctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattttctggatgtcctttatttactgtgacgtgtgtttgggtgccttgtttaggggtagaggtgaagtctgagctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcaragtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgawcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgntctggatcagaagatgcgcccgagcactgacaccatcacagtcatggtggaggtgagtccccgamctctggacttcctgatcctggncactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaaraaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccagnccatcttgatgaaatgcagttagacatccaggccaggtaatacctccctccccacctctgcccaccagcaccgggtcctgctccctactcagtatgaatgggctcctgcttccctgccctcgggccattattccccccagcccttggnccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttnccctggctgagtttatttatttctttgctcgttctgctcattccttcactcctccagtggacatgtgttgttcaatgccctgtgctgggcctcagcatgtacagacaggaatacagcagcctgcgccctgggagctcactgtcttgtgggagggaaccactcaagccactccctacttgtcctcctgtccctctcntcntgggctctgtcccccacctctctctncctttgtcttncaggtggggagatggaggagncagagctcacatcctggtattttgtgtcatctcccttctccttggatcttancaagaccaagcgacaccttgtgcctggggcccccttcctgctgcaggtttcttccagaggggaaggatgagtagggaggatgtggtagttaggagggctcagggtctnaccactctnttttgcctgacctcctttacctgactaggncttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggmtctganctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgagnctgtcccatgaagagncaaccactcttgtccctcccattcttggcccagatcctatcccgagggcagatcktgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagngggcctggscttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttggnctctccacctgggatccgggttgggggtcttcctctctgcccctcggctccttkytgaacccacgtgtkgtatttggggccagagatccgaattccgggattacgagtggaaggtggncagctctctccagcagcctctcttatgttgctgntctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaaggnccagncggncctccaacgaggtgagggnctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctswttccatttccctgtaccccagntccctgtyccctttgctcttagtgtaggaagagggtccagtgatctggggaggtctgtgtcagcgtgcagatggcgtgggccagagggcagaggcggactgagacagagctgggyacccccacccctccctcctgtggccctgaagctttgatggcccctctgatctctgcccctgtgcccacgcttcctttccctcaggcctatgtgtggccaccccagttcagctccgggtgttccgcgagttccacctgcacctccgcctgcccatgtctgtccgccgctttgagcagctggagctgcggcctgtcctctataactacctggataaaaacctgactgtgagnccccatgggagcctgagcatacaggagttggggganccaggncccagtgaggggtggggagnctaaccgggccaggactctggccatcctcgttttcctgccctcaggtgagcgtccacgtgtccccagtggaggggctgtgcctggctgggggcggaggtctgncccancaggtgctggtgcctgcgggctctgcccggcctgttgccttctctgtggtgcccacggcanccaccnctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccaaaccaatgccttggtctgttcccatcttctacaattctgatccaactctgtccctggagttgaaactcaaagttctgggggagtctgtgctagcagggcaggctgtagtcctgtgtgacctnacaaccatgttttccctganacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcaggttacaggtgggagtgcccttgtagtcccttcccagtggccaccttcggattcatgtgggacctgtggatccctgcttggtcccactccccgtgagcctctgacacagagtcctcagacctccaccctctccctcccatgtagcctmagatccattggacactttaggctctgagggggccttgtcaccaggaggcgtgscctccctcttgaggcttcctcgagkctgtggggagcaaaccatgatctacttggctccgacactggctgcttcccgctacctggacaagacagancagtggagcacacttcctcccgagaccaaggaccacgccgtggatctgatccagaaaggttctgggtgcaagggcaagcaggaggggggccaggaaaggacagttactggaagatggacagcccaggaggctacagagggaaaraaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacggggcagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaagctcatttttgggggagaaagcaagtgctgggctcctgggtgcccacgcagntgccatcacggnctatgccctgacactgaccaaggcccctgcggacctgcggggtgttgcccacaacaacctcatggcaatggcccaggagactggaggtgaggggtgaggggctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggtttgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtsctggtataaactttgtggaaatgtgaggtggggagaggaggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagnaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgntggtggntccgaatcccactcctcagaccagggctcttccctgaaccatgggccccactcgtcccactcccacagcacctcagacgaggcatgtcccaaagcccttcttcattctgtgtctcttgtctggctggtgggagsccctcccagccaggagsccagscactactctagaggccgtgttagtggcccctctcccaagnctgtccttatgtccctagtgactcctcctctgctcccctgctgnctgtggcccttggtgctgcatcctagattctgtgctgagacggccttctccctacctggaacttctctctacctcctgtctcccctgtctgatccactgtccacamgggagtgacactgaccttccaaaagccccagmcagatcagccttggggaaaagtcactccccgctgcccacggntcagatggctgggcctctgcccacccctccggccagacagdtctccttgtctacamagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcctgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcagncggcagggaccgatgccagtcagcagggaccctcagggtttgagagggagtctttcctaatgctggttttattcagcttgaggggctgcctttgttttnttgttgaacttcctatcttntttttaatattaaagcgtatttyccttnacaaagtgatggtggccatagatgatagttgtatttgtcttttcacgaccttatttggctaaaatagttatcaaccctcttncggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccscgtggrcacgargaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaasccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgaggccctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtggsctttgaggctgtgcaggaagtgccggtggggctggtgcagccggccagckcaaccctgtacgactactacaaccccggtgagcactgcaggacaccctgaaattcaggagaactttggcataggtgccctcctatgggacaatggacaccggggtagtgaggggkcagagagccctggggctccctgggactgaggagncagaatggaggggcctgtgccctaactcctctctgttctccagancgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcntcgcgccctggagcggggtctgcaggacgaggatggctacaggatgaagtttgcctgcwactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtntcttgtcctccccatgcctcgccacctaggccttgnccctcagaagccagatgcctgtgctctccgtttccacctgccatcctcccgagccctgttgactgtccctttgncccctgcagnccccagtacctgctggactcgaatagctggatcgaggagatgccctctgaacgcctgtgccggagcacccgccagcgggcagnctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctct

SEQ ID NO: 276 - DNA, 403 bp, Homo sapiens
taaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgc

SEQ ID NO: 277 - DNA, 11373 bp, Homo sapiens
ggatcctagatattccttagtctgaggaggagcaattaagattcacttgtttagaggctgggagtggtggctcacgcctgtaatcccagaattttgggaggccaaggcaggcagatcacctgaggtcaagagttcaagaccaacctggccaacatggtgaaatcccatctctacaaaaatacaaaaattagacaggcatgatggcaagtgcctgtaatcccagctacttgggaggctgaggaaggagaattgcttgaacctggaaggcaggagttgcagtgagccgagatcataccactgcactccagcctgggtgacagaacaagactctgtctcaaaaaaaaaaaagagagattcaaaagattcacttgtttaggccttagcgggcttagacaccagtctctgacacattcttaaaggtcaggctctacaaatggaacccaaccagactctcagatatggccaaagatctatacacacccatctcacagatcccctatcttaaagagaccctaatttgggttcacctcagtctctataatctgtaccagcataccaataaaaatctttctcacccatccttagattgagagaagtcacttattattatgtgagtaactggaagatactgataagttgacaaatctttttctttcctttcttattcaacttttattttaacttccaaagaacaagtgcaatatgtgcagctttgttgcgcaggtcaacatgtatctttctggtcttttagccgcctaacactttgagcagatataagccttacacaggattatgaagtctgaaaggattccaccaatattattataattcctatcaacctgataagttaggggaaggtagagctctcctccaataagccagatttccagagtttctgacgtcataatctaccaaggtcatggatcgagttcagagaaaaaacaaaagcaaaaccaaacctaccaaaaaataaaaatcccaaagaaaaaataaagaaaaaaacagcatgaatacttcctgccatgttaagtggccaatatgtcagaaacagcactgagttacagataaagatgtctaaactacagtgacatcccagctgtcacagtgtgtggactattagtcaataaaacagtccctgcctcttaagagttgttttccatgcaaatacatgtcttatgtcttagaataagattccctaagaagtgaacctagcatttatacaagataattaattctaatccatagtatctggtaaagagcattctaccatcatctttaccgagcatagaagagctacaccaaaaccctgggtcatcagccagcacatacacttatccagtgataaatacacatcatcgggtgcctacatacatacctgaatataaaaaaaatacttttgctgagatgaaacaggcgtgatttatttcaaataggtacggataagtagatattgaagtaaggattcagtcttatattatattacataacattaatctattcctgcactgaaactgttgctttataggatttttcactacactaatgagaacttaagagataatggcctaaaaccacagagagtatattcaaagataagtatagcacttcttatttggaaaccaatgcttactaaatgagactaagacgtgtcccatcaaaaatcctggacctatgcctaaaacacatttcacaatccctgaacttttcaaaaattggtacatgctttaactttaaactacaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggttcctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggcaatgttttagggcctaaggagtgcctctgaaaatctagatggacaactttgactttgagaaaagagaggtggaaatgaggaaaatgacttttctttattagatttcggtagaaagaactttcacctttcccctatttttgttattcgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgcgcgcgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatacaaataataaatctattctgctaagagatcacacatggttgtcttcagttctttttttatgtctttttaaatatatgagccacaaagggttttatgttgagggatgtgtttatgtgtatttatacatggctatgtgtgtttgtgtcatgtgcacactccacacttttttgtttacgttagatgtgggttttgatgagcaaataaaagaactaggcaataaagaaacttgtacatgggagttctgcaagtgggagtaaaaggtgcaggagaaatctggttggaagaaagacctctataggacaggactcctcagaaacagatgttttggaagagatggggaaaggttcagtgaagggggctgaacccccttccctggattgcagcacagcagcgaggaaggggctcaacgaagaaaaagtgttccaagctttaggaagtcaaggtttaggcagggatagccattctattttattaggggcaatactatttccaacggcatctggcttttctcagcccttgtgaggctctacggggaggttgaggtgttagagatcagagcaggaaacaggtttttctttccacggtaactacaatgaagtgatccttactttactaaggaacttttcattttaagtgttgacgcatgcctaaagaggtgaaattaatcccatacccttaagtctacagactggtcacagcatttcaaggaggagacctcattgtaagcttctagggaggtggggacttaggtgaaggaaatgagccagcagaagctcacaagtcagcatcagcgtgtcatgtctcagcagcagaacagcacggtcagatgaaaatatagtgtgaagaatttgtataacattaattgagaaggcagattcactggagttcttatataattgaaagttaatgcacgttaataagcaagagtttagtttaatgtgatggtgttatgaacttaacgcttgtgtctccagaaaattcacatgctgaatccccaactcccaattggctccatttgtgggggaggctttggaaaagtaatcaggtttagaggagctcatgagagcagatccccatcatagaattattttcctcatcagaagcagagagattagccatttctcttccttctggtgaggacacagtgggaagtcagccacctgcaacccaggaagagagccctgaccaggaaccagcagaaaagtgagaaaaaatcctgttgttgaagtcacccagtctatgctattttgttatagcaccttgcactaagtaaggcagatgaagaaagagaaaaaaataagcttcggtgttcagtggattagaaaccatgtttatctcaggtttacaaatctccacttgtcctctgtgtttcagaataaaataccaactctactactctcatctgtaagatgcaaatagtaagcctgatcccttctgtctaactttgaattctattttttcttcaacgtactttaggcttgtaatgtgtttatatacagtgaaatgtcaagttctttctttatatttctttctttcttttttttcctcagcctcagagttttccacatgcccttcctactttcaggaacttctttctccaaacgtcttctgcctggctccatcaaatcataaaggacccacttcaaatgccatcactcactaccatttcacaattcgcactttctttctttgtcctttttttttttagtaaaacaagtttataaaaaattgaaggaataaatgaatggctacttcataggcagagtagacacaagggctactggttgccgatttttattgttatttttcaatagtatgctaaacaaggggtagattatttatgctgcccatttttagaccataaaagataacttcctgatgttgccatggcattttttttccttttaattttatttcatttcattttaatttcgaaggtacatgtgcaggatgtgcaggcttgttacatgggtaaatgtgtgtctttctggccttttagccatctgtatcaatgagcagatataagctttacacaggatcatgaaggatgaaagaatttcaccaatattataataatttcaatcaacctgatagcttaggggataaactaatttgaagatacagcttgcctccgataagccagaattccagagcttctggcattataatctagcaaggttagagatcatggatcactttcagagaaaaacaaaaacaaactaaccaaaagcaaaacagaaccaaaaaaccaccataaatacttcctaccctgttaatggtccaatatgtcagaaacagcactgtgttagaaataaagctgtctaaagtacactaatattcgagttataatagtgtgtggactattagtcaataaaaacaacccttgcctctttagagttgttttccatgtacacgcacatcttatgtcttagagtaagattccctgagaagtgaacctagcatttatacaagataattaattctaatccacagtacctgccaaagaacattctaccatcatctttactgagcatagaagagctacgccaaaaccctgggtcatcagccagcacacacacttatccagtggtaaatacacatcatctggtgtatacatacatacctgaatatggaatcaaatatttttctaagatgaaacagtcatgatttatttcaaataggtacggataagtagatattgaggtaagcattaggtcttatattatgtaacactaatctattactgcgctgaaactgtggctttatagaaattgttttcactacactattgagaaattaagagataatggcaaaagtcacaaagagtatattcaaaaagaagtatagcactttttccttagaaaccactgctaactgaaagagactaagatttgtcccgtcaaaaatcctggacctatgcctaaaacacatttcacaatccctgaacttttcaaaaattggtacatgctttagctttaaactacaggcctcactggagctacagacaagaaggtaaaaaacggctgacaaaagaagtcctggtatcctctatgatgggagaaggaaactagctaaagggaagaataaattagagaaaaactggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgagattatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggcaatgttttagggcctaaggagtgcctctgaaaatctagatggacaactttgactttgagaaaagagaggtggaaatgaggaaaatgacttttctttattagatttcggtagaaagaactttcacctttcccctatttttgttattcgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgtgtgtcagcgtgtgtttcttttaacgtcttcagcctacaacatacagggttcatggtgggaagaagatagcaagatttaaattatggccagtgactagtgcttgaaggggaacaactacctgcatttaatgggaaggcaaaatctcaggctttgagggaagttaacataggcttgattctgggtggaagctgggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgtacacgggagttctgcaagtgggagtaaatggtgtaggagaaatccggtgggaagaaagacctctataggacaggacttctcagaaacagatgttttggaagagatgggaaaaggttcagtgaagacctgggggctggattgattgcagctgagtagcaaggatggttcttaatgaagggaaagtgttccaagctttaggaattcaaggtttagtcaggtgtagcaattctattttattaggaggaatactatttctaatggcacttagcttttcacagcccttgtggatgcctaagaaagtgaaattaatcccatgccctcaagtgtgcagattggtcacagcatttcaagggagagacctcattgtaagactctgggggaggtggggacttaggtgtaagaaatgaatcagcagaggctcacaagtcagcatgagcatgttatgtctgagaaacagaccagcactgtgagatcaaaatgtagtgggaagaatttgtacaacattaattggaaggtttacttaatggaatttttgtatagttggatgttagtgcatctctataagtaagagtttaatatgatggtgttacggacctaatgtttgtgtctcctcaaaattcacatgctgaatccccaactcccaactgaccttatctgtgggggaggcttttgaaaagtaattaggtttagctgagctcataagagcagatccccatcataaaattattttccttatcagaagcagagagacaagccatttctctttcctcccggtgaggacacagtgagaagtccgccatctgcaatccaggaagagaaccctgaccacgagtcagccttcagaaatgtgagaaaaaactctgttgttgaagccacccagtcttttgtattttgttatagcaccttacactgagtaaggcagatgaagaaggagaaaaaaataagcttgggttttgagtggactacagaccatgtttatctcaggtttgcaaagctcccctcgtcccctatgtttcagtataaaatacctactctactactctcatctataagacccaaataataagcctgcgcccttctctctaactttgatttctcctatttttacttcaacatgctttactctagccttgtaatgtctttacatacagtgaaatgtaaagttctttattctttttttctttctttcttttttctcctcagcctcagaatttggcacatgcccttccttctttcaggaacttctccaacatctctgcctggctccatcatatcataaaggtcccacttcaaatgcagtcactaccgtttcaggatatgcactttctttcttttttgttttttgttttttttaagtcaaagcaaatttcttgagagagtaaagaaataaacgaatgactactgcataggcagagcagccccgagggccgctggttgttccttttatggttatttcttgatgatatgttaaacaagttttggattatttatgccttctctttttaggccatatagggtaactttctgacattgccatggcatttttcttttaatttaatttactgttaccttaaattcaggggtacacgtacaggatatgcaggtttgttttataggtaaaagtgtgccatggttttaatgggttttttttttcttgtaaagttgtttaagtttcttgtttactctggatattaggcctttgtcagaagaatagattggaaaatctttttcccattctgtagattgtctttcgctctgatggtagtttcttttgctgagcaggagctctttagtttaattagattccattggtcaatttttgcttttgctgcaattgcttttcacgctttcatcatgaaatctgtgcccgtgtttatatcatgaatagtattgccttgatttttttctaggctttttatagtttggggtttttcatttaagtctctaatccatctggagttaattttggataaggtataaggaaggagtccagtttcatttttcagcatatggctagccagttctcccccatcatttattaaattgaaaatcctttccccattgcttgcttttgtcaggtttctaaaagaccagatggttgtaggtacaatatgcagtttcttcaagtcatataataccatctgaaatctcttattaattcatttcttttagtatgtatgctggtctcctctgctcactatagtgagggcaccattagccagagaatctgtctgtctagttcatgtaagattctcagaattaagaaaaatggatggcatatgaatgaaacttcatggatgacatatggaatctaatatgtatttgttgaattaatgcataagatgcaacagggagaagttgacaactgcaatgataacctggtattgatgatataagagtctatagatcacagtagaagcaataatcatggaaaacaattggaaatggggaacagccacaaacaagaaagaatcaatacttccaggaaagtgactgcaggtcacttttcctggagcgggtgagagaaaagtggaagttagcagtaactgctgaattc

SEQ ID NO: 278 - DNA, 192 bp, Homo sapiens
  misc_feature (153)..(153): Each "n" position in this sequence may either represent at least one nucleotide selected from a, g, t or c,  or contain no nucleotide.
attgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttaccnagaaaaatattaatgtaagccatataacatgggattttc

SEQ ID NO: 279 - DNA, 1524 bp, Homo sapiens
gcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaa

SEQ ID NO: 280 - DNA, 277 bp, Homo sapiens
  misc_feature (87)..(87): Each "n" position in this sequence may either represent at least one nucleotide selected from a, g, t or c,  or contain no nucleotide.
aattatttcactattactgtaaagggttcatcttactctggcattctgagaattagactgaaagtttaatttctgcagttccctcanattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacag

SEQ ID NO: 281 - DNA, 1668 bp, Homo sapiens
atggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccattcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtga

SEQ ID NO: 282 - DNA, 2443 bp, Homo sapiens
gggcgggtcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccaagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgaggctaaaaatttgtcttatgagacacacctatttaagcacagattttggctttattgcccaaaaccctcccgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgctgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaaagtatagtgatacaatgggacatgtgaagaatacagaaaagtaaccactttaatgcaataactgttatcataatattgtatttcgtggtagtccttgcctgtagatatttttaatgccatttaatgccattgtcaccttggatttatgagtgaaaagtgtttctaaaaatatagaaataatgtcag

SEQ ID NO: 283 - DNA, 650 bp, Homo sapiens
  misc_feature (545)..(545): Each "n" position in this sequence may either represent at least one nucleotide selected from a, g, t or c,  or contain no nucleotide.
tgccaaaaacttcactaaaaacaacaaaatttcaccccctatgtccaccccccgccagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtctctcccgctctcttnctcacacacacgcagacatatgagtatgggtttataagttccttttccaaacatgtatattagctttttaacatgtaagtcagtaatgacacatatgtaaagcac

SEQ ID NO: 284 - DNA, 2453 bp, Homo sapiens
gaattccgcctcacagtggccaggtcctgtgccagattgtccctctcaacctccagccgggcgctgttggcgtgagttgatcgagccgcagccgcagctctcgcagctcagcctggtagacgtctgccagcttggtgggctccttggcccgcagctggttcagcctcagcagccagcgccttgttttgctgttccaggaagcgaaccttctcgatgtagctggcaaagcggtattgagctccatcatctctgcccgctcactggcccgggtctccttgaagccagcattgagtgccccagccagggagaaatccacccgggtcggagtggagggggcattcgagccagggagaggcgggtgcaggacccagacggcggccaggagccaggccccccaccatcatctcccctgaggagacgtaggagcggcgagcagcggaggtgatgcgtctcctctccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggcccagcaccatcaagttgacacagctaaggataaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaggttgggtcttttgctgtgcctcctatgtatgtctggtttgctggaagagtgattaatacatctttaatttattaaaaaacaatgtagacctttaaacttcagtcttattgggaataaaagggaacttaattcatacaggtacttgatacagttatacattttccacttacaaaaagaagacaattctgttaaatgaaacgtgtatcgtaaaatgtaattttatttacccacgagaatgttgttattttagcaatagaactcaatgcagatgcattggttattaccctgtgtaccttgtccctcattttgctgtgacaccctgaaaaagctgaccacaaatgcagtattatcattgacatacctctgtcctcctcagtgctttttaatgtaatttcaccggaattc

SEQ ID NO: 285 - DNA, 1755 bp, Homo sapiens
cctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggaaaagaagagcggcggcgccggcaaggtcaccaagtcggcgcagaaggcgcagaaggcgggcaagtgaagcgcgggccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 286 - DNA, 5504 bp, Homo sapiens
aagctttttgtggcaacctgtatgaacgcggagggagaagtgccctagaccagcctccagatcgttcctactggggctgtcagcggctttagctcactgggcgctagatgggagtgtcccctccgtacccggacgaaggcggggcgcccgctggcaaagcgcattttccagcgcaagctgtttggggtgcggggctggcgagtgagggaaaacagagggtggcgcgcccaccatcagcgtctgtgcagccccacctgcgccgcgggttggtctcagccggatcctgcagccctcatcgagcaaaggctgggcgcggcgcccccactgccggggagggaagaggctgggaggacgcaacaggcccaggctgtgccgggcggggagcctgggcaggcagctgcacccccagccccagagggctggggaaggccggcccgaccagcagcaggaaagggggcgctaagtcgccttcaagcccgcacggctctcccggcctttcctcctgtcctcagagtcagctcccccgcccgggacgtcccgcgccactccgcgcctttggccctggctcaaggtcttgtgatgtgattagacaaagccgacgccttgtcctcagacactcagccctgcccggcaggccccggacgctcaagccctgtttactgagcctgggcggggagggggcggaagaaacgagcccgggctccaccggcaagactgccgcggcggccgcccgcgtggccacccccacccccaccgcgactccacgtgcagtcgggctggagccgccaccgactggacgcaggccccgagcccccgcctcctggccggggcaccctttgcaaacccgccgggccgcggggctggttgcgaatatctggcattttgcaattcccgcgcccagtacaaaaccgaagtggagcttaaagctccacaggtccgccgtcggagaacagggcagggaaagacacgtccagggctgcagaatcccggccacgctaaacgaccgggctctccgaccgcgcaccccggaggagaacagccgtgccttcccgccgccacccggcgcatccactggggccgagactacacgccacaccggccgcccgaccgcgggccccgcccggaggcctggagcaccctcccccggaggtaaaaaaattgcgcggccaatgggaggccgggaaggcgcctgacgtccgcgagcgggcgggcggcgttgcctggagaccccggcgggggccgagttctgtcccctcccccggcgcgcccgccccgccgcagccgcactcccgggctctatttagggcgcgcgctcggcggaggccgccgagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaaggtaggccagggacggggcccggccggcagcagccgttgtagttcttggactttgcctctgtccccaggttctgggggacgcccctcccgccctgcctttcaaagcgggaaagtcccggggtttgcaaaagagtgtccgacccctgagcgggaggacgccgtgtcgcggttgagtttctccactgccgaccgcggccacgctgcccggggcttcccggacagcttcgcgccgcccacctcggcagccggggcggaggatcacgtgtcgaaacccagcgcggcccacggtgggcgtcctcccctctcccgctccgtccagcaagatcttgctggttttgcgcgtgtataggtggagggtggaggcgagtcgggatccgccaagagtgggggaaaaaaaggaaaagaatcagctgggagttcctctgcggctcgccccgagtctgtcttccccttccgtttttcatcccttccccgctcccctccctttggcagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccggacctctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggaccttcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggccgctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagtctgcaagccctaccgagcacttggactcgaactctgtgccgggaggggcccccacccctcctttttcggtttcctcttgtctttttttttttatttttattacgaagtttcattctttttgagcaaaaaagtcgaactttttctgttgaataaaatattcacaacagggcagttgtgatacgaatagaacaaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaagctccatactggttacttggtttcattgccaccacttagtggatgttcagtttagaaccattttgtctgctccctctggaagccttgcgcagagcttactttgtaattgttggagaataactgctgaatttttagctgttttgagtgattcgcaccactgcaccacaactcaatatgaaaactatttaacttatttattatcttgtgaaaaatatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaatgaaaaaaatgaccacatactttgcaatcaggctgaaatgtggcatgcttttctaattccaactttataaactagcaaaaaagtgtttgcttattccaccagttctactgtgacatactcgagtataaagacatgtagccataacggggagtggggggggagtctccatgcctttgaagggcccgactgccttaaatcttcctcaaccaaatacgtattttattagtgattgagagaatctgaatgtaggatgggttcaactgcacaaaaggaaaagatttttaccactttttttatatagatataaagtgaagcaacccgccttagtgctgaaatatgtagtacatgaatatgccttgtttaattacagaaaattccaaaacttgtactatttttttttccatgtagaaaggcaggaatgtctcctaagctttcctggcagcagatgaatcagcggtagctttagtttgtcgtaggtacagttggagcactatatgtactctctggactactttggacagaagtaggtttttgaatgtaacaagataagtcaacttgagttgtaatatattttgggaaatcagctcactacaaattgtagactgtaaacattgtactgtaaatgttttgtagttttcccccaataaaatttttgggaaaaaagggaattc

SEQ ID NO: 287 - DNA, 780 bp, Homo sapiens
  misc_feature (506)..(770): Each "n" position in this sequence may either represent at least one nucleotide selected from a, g, t or c,  or contain no nucleotide.
tttttttgactattacaaaagtttatttaacaaaaagtctaatttgaaaatgtacatgacctaatttttacatcatagtaaaacaggccctatggagagaggacatgggtttctctgctgaacagccattatttatactcgttccaaggcttctaacatgatgatactatttcctcgtattaccaccattccaatattgttctgttgtccactagtcgccatctccacacattcatctatcacaaggttcataaagggatcaaatccccgcaatattccttggacatgtctgccaccatttaatttcaatgataacttcttgtccataaattttttcaactcgggagggtgagctttgctcatggtgtatactccgcgggctcacagatgccttggaacgcaacgcacggctttcctcacgctcccgctgtaggcccggccccaaattccttattgaggatcctagaatacatgagaccagacttggaaatgaagtgtaacatgtntattgttcaaaaagaaaaactcanaggtgtgtgtgtgtgtgtgtgtgtgtggacacgccccgggcagttgtctgtgccaagcgcgagacccactgtccttctgcaaaagaatggcaggtgataagcactgccccctacgtttccagtacctgcagatgacatgngaggctgtgncccgaaagcgaccctgcgtcaaaggggagtatgctttgctggctgaatgaactgctccccttcccttttactnccggcccggcgctntancctcccttaa

SEQ ID NO: 288 - DNA, 7217 bp, Homo sapiens
gcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattactgcagcttggggaggcccatcaggctgagactgaagtcctgcggcgggagctggcagaggccatggctgcccagcacacagctgagagtgagtgtgagcagctcgtcaaagaagtagctgcctggcgtgacgggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacaaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaagcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagagctgcgcctgctgcaggcagagacagccagcaacagtgccagagctgcagaacgcagctctgctctgcgggaggaggtgcagagcctccgggagggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggaaaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcttccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagtgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggcccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctattttt

SEQ ID NO: 289 - DNA, 1367 bp, Homo sapiens
gaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtg

SEQ ID NO: 290 - DNA, 1541 bp, Homo sapiens
ggaattcccgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacttttttaagtgttgtgaagtgggtcttttctttgggtctgtttctagcc

SEQ ID NO: 291 - DNA, 489 bp, Homo sapiens
  misc_feature (452)..(452): No nucleotide residue exists at n position 452 according to the corresponding sequence (KIAA0669 gene) in the Entrez Human Genome Sequence Database.
tttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcacgagttattgtgatatgataaataattgggctattttgatgaagaaaactttgttcatttgtttctactttctaagagaaattgccacgattcctctgctttcaacatttcgtatgacttttttttcgggtgggaataaaaagctgtgaaattgttcaacctactttgtaaccaaagaagcaaagctgtgtaatggagtttggtttttttttggtggttttttttttggctttntttttttttttaatgcacattctttatgtatttttat

SEQ ID NO: 292 - DNA, 3938 bp, Homo sapiens
gtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgtggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttgcctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 293 - DNA, 1200 bp, Homo sapiens
actggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaaggccgccgtgacctattcaccctccacttcccgtctcagaatctaaacgttggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctcctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttcta

SEQ ID NO: 294 - DNA, 6356 bp, Homo sapiens
gccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcgttgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtagacaatatagattttgtctttgccctctgtggtggttgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgtcgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaat

SEQ ID NO: 295 - DNA, 2177 bp, Homo sapiens
gaattcgcggccgctggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcaacgggggaggcagacggcaagacggcggcggcagcggttgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctcccaaaaaaaaaaaaaaaaaaaaaaaaaaaagcggccgcgaattc

SEQ ID NO: 296 - DNA, 1240 bp, Homo sapiens
ctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacaaaaaaaaaaaaaa

SEQ ID NO: 297 - DNA, 4519 bp, Homo sapiens
ttggcccgtgcgtggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgaacccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaagactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagaatagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtc

SEQ ID NO: 298 - DNA, 244 bp, Homo sapiens
ctgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatc

SEQ ID NO: 299 - DNA, 1098 bp, Homo sapiens
tcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacatcacttgaaaggccagattactcagcagatctcccatgttggctcaacaattctttgtttttaattgcttgaagattgcattgttgtaattgttcagtttttaaatgtgtaatggcattttcaatagactagtaaatcacagtggttcaaaatatatatccatatatatatatatcccatatatatatctcatgtcatcacattacaggcaggtgtctcatatgtaaaacatttacctgaatgttgtctgaggactgaactgtggactttactattcataatgataaaataataaaatgcgaattactat

SEQ ID NO: 300 - DNA, 1698 bp, Homo sapiens
agacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacttaactaggaagtggcagaactgattctccagccctggtagcatttgctcagagcctacgcttggtccagaacatcaaactccaaaccctggggacaaacgacatgaaataaatgtattttaaaacatc

SEQ ID NO: 301 - DNA, 6359 bp, Homo sapiens
ggcctggctgttgctcaggtgaccagcttgtgtctctgggagggcgctgctttccccggccacccggcgcgatgatccagaatgtcggaaatcacctgcgacggggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgaaccgggccttcaactccagcatggaggtgggcatccaggtggcctcggaggacctgtgctctgagaagcagtggaatgtgtgcaaggccttggccaccttcgtggcccgccgagagatcaccaaggtgaagctgaagcagatcacgccgcggacagaagaggagaagatggagcacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccagccggctctgccgtgcccaccctacgctgaaggccattgaaatgttccacttccgaggcccgtcccaggtcggcgaccgtctggtgctcaaagccatcgtgaacaatgccttcaaacatagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgatggtgagcggcggtaccgagaggccagtgccagaaagaagatccgcctggacaggaagtacatcgtgtcctgtaagcagacagaggtgcccctctccgtcccctgggaccctagcaaccaggtgtacctgagctacaataacgtctcctccttgaagatgcttgtggccaaggacaactgggtgctgtcctcggagatcagtcaggtccgcctgtacactctggaggatgacaagttcctctccttccacatggagatggtggtgcatgtggatgcagcccaggccttcctgctgctctcggacctgcgtcagaggccagagtgggacaagcactaccggagcgtggagctagtgcagcaggtagacgaggacgacgccatctaccacgtcaccagccctgccctcggaggtcacacaaagccccaggacttcgtgatcctggcctcgaggcggaagccttgtgacaatggggacccctatgtcatcgcgctgaggtcggtcacgctgcccacacaccgagagacgccagagtacagacgcggagagaccctctgctcaggcttctgcctctggcgcgagggggaccagctgaccaagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttgaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcaggggtgggcgggtcttttgagttcaggagttcaggagcagcctggccaacatggtgaggccccttctctactggaaatatgaagattgtccgggcatggtggtgtgcctctgtactttcagctactcgggaagctggggcacaagaattgctggagcatgggaggtgggggctgcagtgggctgagatcgtgccactgcactccagcccgggcgatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtggtcacagctgcttgggaggctgaggcaggagaattggttgaacccaggaggcagaggttacagtgagcggagatcgtgccactgcattccagccggggtgagagagcgagactctgcctcaaaaaaagaaggcttagtgtgcaactcatcagagttgcacagggcagagaaagaatgggaaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttgagctcctggcttcaggctatcctcccaccatggcatcctaaagtgctgggattgcaggcatgagctgctgcatctggcccaaagtaaaagatcttagaagcagccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacggccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttggaggcactttcactgtgttgcccaggcctgtctgttggcctcaagtgatcctcctgccttggatctcccagggtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttggggggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctc

SEQ ID NO: 302 - DNA, 3424 bp, Homo sapiens
caaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacagcagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttt

SEQ ID NO: 303 - DNA, 3190 bp, Homo sapiens
attatacccattgttagctgactggattaaagcacatgatagtttaccttttaacagcataatgcaatattagaaatagttgaagaaattggaaggagtttcagaaatgtagctgagtttctcctgggcttaagggactttatagctcatgttcaaatgcaccactgtctctctgaattacagatgatctgtttttctaacaatacgacctgacgattttttttttttttaagagacagggtctcgctctgttgcccagactggagtgtagtggcgcggtcttggctcactgcagcctcggcctcctgggctcaagggatcctcttgcctcaccctcccgggtagctgggactgcaggtgtgtgctaccatacttggctgattttttaattttttgtagagatggagtctcgctgtattgcccaggctggtctcgggctcctggcctggggtgatcctcctgccctggcctcccagcaaattttttaaaataaattggctgggcacggtggctcccacctgtaatcccagcactttgggaggccgaggtgggcggatcgcctggggtcaggaattcgagaccagcctgaccaacatggagaaaccccatctctactaaaaatacaaaattagccgggtgtggtggtgcatgcctgtggtcccagctattcgggaggctgaggcgggagaatcgcttgggcctgggaggtggaggttgtggtgagcagggattgctccattgcactccagcctgggcaacaagagcgaaactctgtcaaaaaaaaaaaaaaaaattctcctggataataaggctctttgaaaggaggattactcattgttttacgtaggaatatatgatgagtattatttagcaagactgttgctaaagaatatctgatgagctgaaaacattcttagtaaattgaataaatgtttaagggaaaaaatacgtagtatttatatttcattgtttcaacttgagaccatttcagatcacttcggaagtaatttaattcatcggagtatttgtaatatatgtttctaaaaaagtttagttctaaagatcagagaaaaagcatgacacaaagcgttttgactattttatgaatatgtgaattgaaagagaatgtacataatcatgtagtttccgttggcattggccggtttgtaatttcacaagagtcagatgaggtcatctacctgcagtatgtgaaggtgaatgtaaagtcatgtgactggacatgatgaagatgaagagggactctcgtttctttctgtttaagccaacacagctcagagtccttataagaaactgaaagaagcattatcgtcagtggaagcttttgaaaaacactacttagtaagtattaacaagtgttcaatgtctgttctgtgaatacctgtctctagaaggctttgctacatggcctgttgagttgggaaggaactggtgtggggggccccttcttgttggttttttttagtttctttggtacctggggagttgtggacaaaacatggagtagttcatcaaatgtgtattagtgcccatggtaccatgctaggcatggaatcatctttgaatatttaccgttttgttcaaattgggtttgctcacacagaaattataagagaggctagtgaatacttttctttgtaaaaaggagtaatttggacttgggcagagctattgtatttgattttgaaagacttaaattagcaaaactttaaaaaacggtgtaggcagaagtgtggtgggtcagcgtcattcccgggtcatgggcaacttgagcgtttggtctgcccgtaatggctgtacctcttatacacacaagtatgaaaaatacccagcatgtcacccacgtgcagaaagtccttggaaaagttagatgttttggatgagtttgtgggtttcttttattattatgcttcataatttatacacaggttaccaattttgcttatatattacagaaaaattcacaaaaatagatgcaaaggaaaaaataatgttacattattagcaatgtcttctgcgggctgggcatggtggctcacgcctgtaattcagcactttgggaggctgaggcaggtggatcacttgaggtcaggagtttgagaccagcctagccaacatggtgaaatcctgtctctgctaaagatacaaaaaattagccgggcctggtggcgcctgtagtcccagctacttgggaagctgaggcacaagaatcacttcaacctatgaggcggaggttgcagtgagctgagatctcaccgctgtgctccagcctgggcgatggagcaagactctgtctcaaaacaaaaacccaacaatgtcttttgtgtgagctttaggtgaataaatgtagtatttgtccatcattaaaagttcaagtacataattgtgtttttacttccccacaggatttgtcccatgccaccattgaaatgtatacaagcattgggaggattcgatctgctaagtttgttggaaaagatctggcagagttttacatgtaattgattttgtacttttctttgaattctaaacatacaaataacacgagaagatttgttatatatggagttagtataaagtgcacataaatttgtagactgaaaagtgtagattctcttacccagtcctcataatttttttttcagtttcttctgaaaaccagatggagagattttctgcttgttactcttaataactgttattggtctttgaggttcttttatttaattaaatatatacatttttgtaactaagtttaattaaagaattataagacagtataatggtgagtaaattggcatatagattcttacatattttgttatatagcatttctctaattttatcaagtattaagaggactgaaaaacctcaaggccattgatgtaaagctactgcatgtgtcaggttcatgaaagagggatgatctagggatgactggaagaaggtgtgtacaaagactgcagggtttccattccagctccagctttgaagtttgattccagaaaaactcaaaatttagcgtatttctggtgtgtttcataaaatcagactatcaaagagaagaaaccccagtgggtcatgtggttaccatttcagagtactcaaaggagatacaagctataaggaaaaagatgcttgttttcattttctaaaaaaaaaaaaaaaaagg

SEQ ID NO: 304 - DNA, 1666 bp, Homo sapiens
cctctatagatgggctttagtaaagactgtcccaaagagcccctacttctctaatgccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctgctctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaaaaaaaaaaaaaaaaaaaaaaa

SEQ ID NO: 305 - DNA, 2460 bp, Homo sapiens
agagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaag

SEQ ID NO: 306 - DNA, 161 bp, Homo sapiens
ttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggttt

SEQ ID NO: 307 - DNA, 2285 bp, Homo sapiens
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaagcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttggg

SEQ ID NO: 308 - DNA, 540 bp, Homo sapiens; identical to SEQ ID NO: 103

SEQ ID NO: 309 - DNA, 2763 bp, Homo sapiens
ggatcccagtggcccggcgtgctcggctcccacaggcctgcagccagcatcgcaccgaaccttcggggggccgcggctggagcgctcggccggcgtgggagcgcaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaagcagctaaaaatgacacagcttatttaccatgcccctgacactgcactgagcactttatgagcttgaactctgttaatctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtcatcactccccaaaatggacgttaccaaatagattccgatgttctcctgatcccctggaagctgacttacaggaatattggttctgattttattcctcggggcgcctttggaaaggtatacttggctcaagatataaagacgaagaaaagaatggcgtgtaaactgatcccagtagatcaatttaagccatctgatgtggaaattcaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacctagcaacattgttttcatgtccacaaaagctgttttggtggattttggcctaagtgttcaaatgaccgaagatgtctattttcctaaggacctccgaggaacagagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtacgagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgcctctaaattaagacagcattgatctcctggaggctggttctgctgcctctacacaggggcccgttacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagcctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagacggccactagtgacagtttcttttgtgttcctatggaaacattttatactgtacatgctatgctgaagacattcaaaacgtgatgttttgaatgtggataaaactgtgtaaaccacataattttgtacatccaaggatgaggtgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacatgtaaagtatgtgagtagtcttatgtaaagtatgtttttacattatgcaaataaaacccaatacttttgtccaatgtggttggtcaaatcaactgaataaattcagtattttgcctt

SEQ ID NO: 310 - DNA, 4053 bp, Homo sapiens
caccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctag

SEQ ID NO: 311 - DNA, 1860 bp, Homo sapiens
gggacagcctctcctgccgccgctgctgctgccgccgccgccaccgccggctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggaaaaaaaaaaccc

SEQ ID NO: 312 - DNA, 921 bp, Homo sapiens
ccctcggacggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggcgtggtccacggtacttgaagaagccagagcccacatcctgtgcactgctgaaggaccctacgctcggtggcctggcacctcactttgagaagagtgagcacactggctttgcatcctggaaggcctgcagggggcggggcaggaaatgtacctgaaaaggattttagaaaaccctgggaaacccaccacaccaccacaaaatggcctttagtgtatgaaatgcacatggaggggatgtagttgcatttttgctaaaaaaaaaaaaaa

SEQ ID NO: 313 - DNA, 1919 bp, Homo sapiens
caggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaatggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattatt

SEQ ID NO: 314 - DNA, 1660 bp, Homo sapiens
ggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacttatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcaaaaaaaaaaaaaaaaaa

SEQ ID NO: 315 - DNA, 2787 bp, Homo sapiens
cagctggaattcggggcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcaccaaaaagtttcctacaaaggggaccccattgtacagcaccggccgatgctggaggagaggatcgtggagctgttcagaaacttaatgaaaagtgcctttgtggtggagcggcagccctgcatgcccatgcatcctgaccggcccctcgtcatcaagaccggcgtccagttcactactaaagtcaggttgctggtcaagttccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggtctcaagattgacctagagacccactccttgtcagttgtggtgatctccaacatctgtcagatgccaaatgcctgggcgtccatcctgtggtacaacatgctgaccaacaatcccaagaatgtgaacttcttcactaagccgccaattggaacctgggaccaagtggccgaggtgctcagctggcagttctcgtccaccaccaagcgggggctgagcatcgagcagctgacaacgctggctgagaagctcctagggcctggtgtgaactactcagggtgtcagatcacatgggctaacttctgcaaagaaaacatggctggcaagggcttctcctactgggtctggctagacaatatcatcgaccttgtgaaaaagtatatcttggccctttggaatgaagggtacatcatgggtttcatcagcaaggagcgggagcgggccatcttgagcactaagcccccaggcaccttcctgctgcgcttcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctgttgtctccacttgtctatctctatcctgacattcccaaggaggaggcattcgggaagtattgtcggccagagagccaggagcatcctgaagctgacccaggtagcgctgccccatacctgaagaccaagtttatctgtgtgacaccaacgacctgcagcaataccattgacctgccgatgtccccccgcgctttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatg

SEQ ID NO: 316 - DNA, 355 bp, Homo sapiens
  misc_feature (304)..(327): Each "n" position in this sequence may either represent at least one nucleotide selected from a, g, c or t, or contain no nucleotide residue.
cagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttcntaaccagtgcatagtanttctantaaaacagggagcctgttattcttttgg

SEQ ID NO: 317 - DNA, 1670 bp, Homo sapiens
cggcacgaggcaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaagagacttttttttatacgataaataacttttttttaagttacacatttttcagatataaaagactgaccaatattgtacagtttttattgcttgttggatttttgctcttgtgtttctttagtttttcgtgaaggtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaa

SEQ ID NO: 318 - DNA, 859 bp, Homo sapiens
gaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactc

SEQ ID NO: 319 - DNA, 518 bp, Homo sapiens
ttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagttcatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaa

SEQ ID NO: 320 - DNA, 5109 bp, Homo sapiens
actagttatgtcaatttcacctcaacaaaaaaatgacacacagtactcagattttaaaaagcatcatttcaccaagattccatgaatcaatgtgagatgatcaaagaggattcagtagaatcgttcaacttcgaatgtaaaacagtcctaaactcaaacctttgggacactaaagtggggagatggtatgtgatagttttagatagtaaaaattattcttgtttacttggtctcgaactcgaacttttttgaggcggagtctctctctgtcgcctgggctgcagtgcagtggtgcgatctggactcattgcaacctccgcctcttgggctcaagcgattgtcgtgcctcagcctccctagtaactgggactacagtcgccccccaccacgcctggctattttacctatttttggctattttacctatttttattagagacggagtttcgccatgttggccaggctggtctcgaactcctgacctaagatgatccgcccgcctcggcctcccaaagtgctgggattacaggcgtgacgaccgcgcccggccttagccctcctattttggtaccgtcagatgcaaagtgcctgggacagaagtggggctccgctggcgcccagctccaaaacccaggcagcgtggaaaagactagacagggaaggggttagccctcagaattacacgcgggtttgccttaccagactaccaccactggcacaacctcagacccacacccaaccgactttacctcccaggccctgattaatctcgcccggaagtaccgcccacccatgctcacttccgctatcccgtacttctgctcatctcgcgagaactgaaagcgcctatgtgacctgcgctaagcggaagttggccctcttttccgtggcgcctcggaggcgttcagctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgtttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtattaatccttgcttattatatccagtgccttgtagagtgcagtaatttcgttgaaaatctgcttgtgaatctttgatgtatacattatccaaaaataacctgactttaaggtcattgctatctggtttaggagtcacatgtttgagaattctgggactattagcaccacacactttgtaattttatatcagatgttctaaattattaatattttttaagagatgaggtcacactgttgcccaggctggtcttgaacccttgagctcaagtgatgctcccactttggcttcccaaagtgctgggattatgggcgtgacaccacacccagcccaaaattattttttggcttacaaaagaagttgctttaaacttctgtttcatctgtaggatatggataacaatagttaagagttgtgagaattagaagttagagaccttactcagaatactagggagcaggtgttagggattttggagctttaccttttaagaacttttgtccatatagtagacaacatactcaccagtgaggacctcaaatagcaatatttctgtggtgaaatttggggatatttatgttaaataaacagcatgtcagtcaaggttgggttttcctgacaaaatttgaaagaatttctctggattttagcttttcaggactggtgtacttaacatacatggcatagatagtatacgtctgttaagtcagtaattacacttacttgagcacaggtactgttcaaggtgctgagaatacagtatagacaaatttcctacccttatgaagctgatgttgcaaaaaaaaaaaaaaaagcaattgacaaataggtggcagttgcccataaccatagccctggaaataatccgtataatacaagcgtggtctggttgatgggtatttttagatggttcttatgtctatagtaggaggcttaacattttagcagaatctgaacatctgagcatttagcctaaggcagttaactccctacaaagtgtccatgaaacaaatacatctgaaaaggcctatgctccaatgcagatctgtaatccatgagcagttttggagtacagatcagattaatgaagatactttaacaacatgccacctaatctgatgttaatagttaacgttacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaactggaaggtagtaaaagttagcctggttatttttcaggacttggtttcccttatatttttataatatttaaccaatcttctagatttctgtggaggggcaaaaagcattttagaatagttctgatttgattttaaaggcctcattataggttttcatagatgctgttaagcttacgtttatttctgatgtttttaaagtagatgtggattctaacaaaacaaatattgaaatgattgagtcctttgaatttttaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggttagtctaagatgatttgagggggtgggaggagttcgacctggctttggatttgcgtctttaacccagaaaggccttaactgcttgctgttttgttttgtttaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggact

SEQ ID NO: 321 - DNA, 4119 bp, Homo sapiens
cgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctagtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgcc

SEQ ID NO: 322 - DNA, 170245 bp, Homo sapiens
gatctgttttccagcccagctgggccctggggcagtgtcattgagaccccgctctgtcaactttcctggtgaggggccctgatccagggctgagagattctttcagtgcgagggggaaggaggccttggggcggacttctcaggggctgtcttcttctgtgtcttccctctttccaggtaggggcagaaccaggtcaggcctggacttgttgtccggaagaacagggcataggggtaggggctggacacagctcagaggggctggtgcccatagcggctctgcgtatccagtctcttgtggcctggttctctgtacacatgttccaccccagtgctggggccacctggggcaaggaggggaggctttcctcaaaagttggagatttgggggaattatgtcctctcccttctagactcctgtagcccccctcccaccaagacccctctcgtaggggcactccctaaaggatgtggttctgtggtcttctgggtccctgctcacccagtgggcagagtgcacagatcttccaggacaaggctgtccagtaagggtaacttcaggggccctggatgccccctcctcagggagagggtaggagccagtatgagtcccaagctcttgggccttcccctacccccccagggagggaacgtcattaatgctaatgagcgcatctgggctggggaatggcttgttagagtggtcagtggttgccaggacagagcagcacattaagtgtacagaagcatcacatgggtcctgagccctgctcccatcctcacccaaaggtttgtagaccctggcactttctgccaactgaaggaatgttaaaaccgggaggatttgatattctcaacaatatcaaaggagaagatatctcaacagaggtggtcaagaaatagggatctggtcccctccggacctttaaccagttgcgccatcttggcaggcccctttgggcctcagtttccctgcttggaatgaatgacttctcaagtcccttttctctgagctcctcccagagtctgtctcccagtttgccttccttctcccatgatggaacctgaacttggtggggtctggagaggcgggtgggtgatccagtggcccaaagaagaaggcaaggacaaaccaaggggtgactgaggagtagctcagccagatgaacagggctgaaaaggtggcggggggcaggtgtcaagggacaggggggcttggtggattgggggatcttgcctctgaagtggtcatgggttctgttagggctgaatggcacaaagggtgctcagaggccgcttgggtggctctaccctctgccccactcccagacacctgtgggggtcccagggctcagtgtggaaatcgctggtcctgccctcctcctcctccccgcccaggatggggagaggagcccaggggtctaaacgctgcagctttctgtgaaggggctaggaggtcgcagcctcttcttcccacatgggggctgcagaagctgtggggtcccaggggtggccctgaggatctgcctctgggtagagctggggaggtcagcaggtcacactcggcactgtccctggggccttgccctgccttccctcccctcccctcctggtgttgtgccagccctgggctgtctgcagaaggggccacttccctccagggagaaccctgccagggaaagggctctgcctgtcttccccgacccacaggaggttgaggttagggccagagaggttcatccccctgcacatccctaaagcctcagcccttggggtttcctagagtgccgattgtttcctgtgctccctgccaggcctgaaagggcaggaagtgttagagggaaatgagaatgcaactgtgtgtgacgctggatgtgtgtgagagaagccatgagtgggacattctatgtgggtgagacttgtcttctgtggggctggatgtgtgtggaagagaaccttggtcagagcaacttgtgcagggctgggtgtatgcaggagagaaactgtggctttgtgacattcgtgtgtgtgacagatatacacgtccataagagaaactgggtgactcttcatgtgtccaggtgtgccgccacctctgtacctgagaacctgcatgggggatgttctgtgtgtgccagggcatcacccaggatgtgccgatgaaggaagctggctgcctagccatctgtgtgtacctggagatgacactgggtgtggctctgatgctcaagtgacctgcgtgtgaaggacaccgcactcgcacgatgctgtgtgtatgtgagcgcgcgggcgcgtgtgcgtgagaagccggatgagtggcgatctgtgtgatgtgttacgctgtggtgtgaccacttgtgacctgcatgttgtgacgcagcatgtgagatggcctcaggtttgtctgtgtgtgacttacatgtgacactacatgcgagtaaaacaacatgaccagctctgtgtcagtatgatgtgtgtaccagcaaggtgggccccatccgacatgtgccaagcatgaatatggtatgcggtgtgtgggtgacactgagcaccagaaagcgacaccgtatgtgagagaaaccgtggggcgtgactgatgctggcgctgtgggtgggtggtcactatctgagcgtgtttgggactctcgggtagtgtgggtgacacccccagggctgtgccaggcagggcgtgtaggaggctctgtgggatgcttttgggggcctgtggtccctgacgtgtggcatctatgtggaagacaatgagaaagacactgataaaaacaaagaaggaatgtaattaatgcctctcaattgtacacttagaaatggctaaaatggtaaacttgatgttatgtatattttatcacaataaagacatttttaaaaacccagcaggagagagatgcgggtaacagtgaatgagcaggacagtggctgtgacgcaactgtgtatgcgagcgagaggaagggcgcagaggaaacctatttgttcttagatgacaccgtgactctcatgagggcactgactgagtggctggtgggagcccagtgggcgacccagagtaccaggagtctggcatggtaactgagaactgagaaacccagtgaccccctatagtctgtctctcactggatacctgagattcccaccctgggaccaggacaagatgaggagataagtcagtcccagggagggggtgaagggaggtctggaaactgggcccttctctctacaggggacttgagggctgagtctccaccctcctacccgctatactgcttcagggagcaggagcgtgacaacagatgagatgagctttgcagaaggaggcctggggggactatcccaaccccctctgctccctgagaaagcccctttcccaagtagtgtggggaggaggggcagagaatctccagtcccaaattggaagcacattaataagcagggcggggggtggggagagagtggaggggcccccacctccctcctagtgggctctgcaaattgcttcctcctgtaaaaattgagaccctgttccaggaaggagggaagccctccccagcctggcagggtgtggctgcttggcagggtccctccggggtccttgggctggaggtgggggagacagatacatccctacttgctctgctgccccagagcatggctacttctagggtgggagcttctggcagctggagaacagctggcccgctgtggggcgggtaggggaggagggaggaaaaggcagagagggtgggagcctcccttagccctcctcagctgccctccccatcctcgacccccccggctggtcagcccagctcaggtttgagggcagagatttgggaggaaactgctgatttcactgatcttgccacattttgagtgatgttctcactccaagtgagaatgctttgggggctggggtccctgcaggggtggactgctggctgctagacccaggaaggtcacagctcagctcgtcctcccagcagggctggtgcaggggaaggggtaagacaggaggtgcccactcacccagactggctttttctgtgcctcctaccaaggcagtggctctggggcccctaaagggagctacagggctgggtggtctggaggctgcagggtctgtgggggtgggggaccagggcctctgcagcggccccagctccagcctgatccctggagctgtccagccagttcttccagcaggtcttgccccagggtgggggtgggcagcaaggtgccccttatcttccccagggccccaaagcctgctcacccagcctcctagcccccatccctgcctccacccagaggccttctgagcctgaaaggctgagggccctgggagaggggaagcgggtgtggctggtcaggatgagggtgaaggcagactgagtcccctgggggtctgcagcctgctggcgggtttgcaggacaggtacaacaggactcctctgcagaggcagatgggaggggttctgagaggaggtggagggtaggagcccctgagatgggagtgggggtgtcctggatggtggccagccccagcccctggcagtggcctcccttgtcactccctccctctgttttgccttggcctctgggtctctgtccttgtccctgtctttttctttctccccatcccctcctggtctgcccctccctcgatgcctatcatatctgagtttctggtctacccctctctgctgtgtgtctctttctaggtctttgttggttgccttgtctgtgcccctcccctgccctccttctccccttctcccttcaccccccaccggctctgtctgtcagtctgtgggtctgagggtccagcactcccccgccctgcctccacatctctcctggggtctctcccttcactctgcggggctctggtctgtcccccactgggttgggctttctgtctgtcactcactgggactctcctgtctctggtctgttttctctctgggttcacctcagcttctctttgccccagactctcccccagcctgtctcccctgcccctcctgtctgtctcaggccccaccccggccttggtctccctccccttgaccctcacttgggtctcctctctctcctacccctcttcatggcacagcacagcgaggcagagtttctagatacctgggcatcatcagccagcagcccagggcttgccctctcgcccgcagtcagctttctctagatgtcccacccctccaccaagccagagtcccacatttgccccagcccagcccgcacctgtccagggagccatagcctcctctctcagcccggcctgggtcccagcagttagaggatctagggagaagaaggcgggcacatgctggtctctaggagaacagagcagccagtgctcacgcctcctgcagactcccttccactgagaccccggtccagcccccagacgggggcagctgcctgcccacgactgcccatgtgtgtgcctcagcttgggggtgcacattctcacgtggttgtcctcccgagcactcgcacagcccctctgcacagtgtgctcctgtgcatggctgtgtgtggggagtgccacttgcccctgtgttggtgcctctgccccaggagcgttcctagaaagtgagtctcgcatgcgtctaggagccagccgaagggagggacggtggtcctattctctccttgacacgtcctttgggccgtcccccctcccctccccctcaccagctgccagcggtcccagccaggggccgcctgccccgcccccccagtctgtcccagctcccaagcctgctgctgtgttcgccatatttggccacagtgctcccgcggggggcggggcggggctgacatcaccctaagaagggggggccacagcctgcttgaggggaggcgggcagggacttgggggaggcaggaaagttgctttaaaagtctggggctgcctgggccgctgctgctcgagggaggcctcgggaaaggggttaagaggggccttagctcattgtagcccctcttctccctcccctctaacagctctgtggcagtgtcagactgacacctgtggacaggccctgcatcccaactatttcaacaggggagtccctaggtgcccccacccagctagcacacccctgtccccttaattttttctttttgtttttttaatttaaatttaatttttaaaaatagagacaaggttttcactatgttgtccaggctggtcttgaactcctggcctcaagtgagcttcccagagtgctgggattatagtcgtgagccaccaccccccacatttccttatttatttatttatatttattttgtttacccctcacatttctattccaagaattcccctctcgttgaggagtagggcctggggctctggatccagtttcctggggtgagggacaggctgggaatgagggcatctggcccctctgacaggtcaggggcacagctccttctggccgcccactggccatgggagagagattcctggtggctctggaggcatcacagaaagggctgtacggcagtgcgggggtcttcaagttgctccagttgcttgggttgagggggacctcctgggcagacttagggcagttgctgtgacagctgaacctcctttctctctcaggtggtggggtctctcagcaccctccctataaccttcctggttataaaaccgaagccagcttacctgggttcagaacccagccctagtacttacttgttgtgtgccctaaggcaagttgcttaacttctctgtttcttgggttcctcatctataaactaggaataataatagtatctgccccatagggttattgtgaggattaaatgagtcaatgtgtgtgaaatcccagaacagtgcctggcatatgacaggtactgttagtagtagtaatattaagtctagactcaatagtttagaataattacaataactagttgaatagctgaataactaactgaataatagtttagaataatcaagggccgggcgcagtggctcacgcctgtaatcccaacactttgggaggccgaggctggcggaccatgaggtcagaagtttgagaccagcctggccaacatggtgaaaccccgtctttactaaaaatacaaaaaattatctgggcatggtggcatgcgcctgtaatcccagctacaggtgcgtgccaccatgctgaggggggaggctgcatgggagtctgaggcaggagaatcgcttgaacccaggaggtggaggttgcggtgagcagagatcgcgccattgcactctagcctgggcgacagagcaagactccgtctaaaaaataaaaaacaaataaaaaatttaaaaaagaaaaaaaataaccgaataactggctgacattcagacctcccaggccctccccacctcattctactagtgatcccctcaagcctccctaagcaaacaggtggctctgcagagagagtccaccccgactcaagcagcaggacctggaattcatcttcctctccctggcttctgacggtgtcccctacatctccacccctcccctttccctgctgcccagagctaagtcccaggatccagccatcatgggctcttaggtttccaggaccctgaatacattggacatgtgggttctggggctgaaggggatttggggtgagtcttggggttgtgagtgatagggggcctggtggggtgtggtccaaattaatagcctggcaggttcagggcactcacagtttacagagccctggcccacatgtaggatgggccagggcgggggcgggcgtgttggtggtttacgggctgctgtggggcctggaggtgcgggaacaggaagtgggatagaggagcgggtgaggttgagccaggctgttggccaagcaccttctctgctgctccctcaccagttccctttttgtaattcctggggcagttcctgccctacattaggccccttggcagagttctggttagttatcgatttgggggaagataaaatggtgcccttctgggtcagggactctccttgtcccctgaggggtccttagcagggttgcactgatgctggggcgagagtgaggggtggaggtccctgactggggatgtggacactggggaggaggagctgacagggagagctgaggaaacacagccctgctcctctgctcctcctctctgtgctcctcagcatgcctttggcagctgcgtgaccttgtgagccttagttttcatctctggataatgggctttattccctaccttccctgctttagtgttttttgttgttgttgtttgtttgtttttgtgtgttttgttttgtttttttttgagacaaggtctgctctgtcacccaggctggagtgcagtggtgctatctccactcactgcaacctctgcctctggagttcaagtgatcttcgtgcctcagcctcctgagtagctaggattgcaggagtatgctgccatgccctgctaatttttttttttttttttttttttttgaggagtctcgctctattgcctaggctggagtgcagtgacgtgatctcggctcactgcaacctctgcctcctgggttgaagcgattctcctgcttcagcctcctgagtagctgggattacaagtgcgtgccaccatgcccggctaatttttgtatttttagtagagatggggtttcaccatgttggtcagtctggtctcaaacacctgacctcatgatccaaccacctcggcctcccaaagtgatgggattataggcatgtgccactgcgtccagacctgatatatttttaggtagagatgggttttcaccatgttggtcaggttggtcttgagctcctgaccttaaatgatccacccacctcggcctcccaaagtgctgggattacaggcatgagccatcgcgccggcctagttttgtgaggtttgaatgaatatgaaaatgccttttccctacaaaagtgctgtgttggtatgaggcattgttgttaccgattacctatttcttgagtattatgagctgggcatgtggttggtactttgtcatgagctcatttacattttaaccctcacaacctcaaggaggtctcctcaaggagacccttttctcgttttacaggactgaggcctagagaggtgaagtagcgcgtgcatcccaggtcacacagctctgaacaagctgtggttgttcctctggttacctccgttccacctggagcacctgctcctagggtgggcttggggctgggggcggagctccagagccagcggctgtgggataggagattgctgtggtcgaggaggaccctggtcccagttcctgtctgtctgtcccccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggtgcgtgccggggggcgcgggcgggactgcggcccttccccctgctctctgccctctcacccaaccggtttggtgacgtcggaggccgccagccgctggccgggcgagtctgggcgcgcaagcctgtgtgtctggatcctcctccgcgctcctcctcataaacaagccgggctcgccccctaaccagggcgcagcccacaccttggcacccccgcctgctcctcctctcctccccgctaccggcctggaggtttcgaggtgactcagtgggcccaagaaagtgggtcagcccagtctgcgccggtcgaggcccggaacggggtcccttcccggaggaggatgtggaaaggaggcccggtgatagtcgcccggtgactcccacagcccgtatagttctctccagtgcgggctgtgggaggtcgcacggggacaaaggcctgcgttggggctgtggggacgcgttccctcctcagtccccttccccactccttgggtttgttggccctcctctttgccatcttgcccatttccagaagggagtgtcccctcttgtccagccctgagagggctctcccagagctgcatttttgggataactcgacccttctgggcctggttcctggccagctcccctattcctcccagcagcccgtggctgagcgaggcaggcccagcccttcccagggcgcgcctgtgggaagggatcaggtccgctccgtgtcccttggccacgcccacccagccccagagccccaccttgggggcaggcagatggtccagggtgccttccacagggtgggtgctgtctgcccccactgctgcctcccaggctggggagccccacagggtatttttagacagggtggagagagtggggtggagaggggctggcgggagggaggagcaatggggctggttcagtcatcggaatggaatttggagaatttggccattctggggaggccttgggttggagggcagagagcctggatttgggggtagaggtgtacaccttgaccatgctgacttgggctcagccgtgtggcccaggcatccccctttcaggcccaagtccctggacactggcagcttttgggccctcagagggtctgtggtgcagaacagaccccgcaccccaaggctcacaaggctctcacagggtggagagacactgggaactggtgacatgggggtgacaggcacaaggacatggcgacatgctcagtgacacatcttgacacaggccgccagtgtaggaggcacattggaggcggtcagtgctgccttcctgtccttcctggtcttttaccagagaagggaagggacttgaccagggtaaagacagagcaagggcaggacatccacctggggcaggctcattcacacgcccccacaaatccatgcactaagagtactggagctggtgacacaggcaggaagcactgctgggggctgggaggatgggcgtgcctggccaggacaggccctactcagctactgtcctgctgacctgtaccacagccacccggtctgtctgcagggaagcctgtcagggtgcctagtgctgctcggccctccttcctcctaccctgcagcccctcatgcacccctcccctgaagagcagcccctctaggtcctggaggtggtaggatgcagctgtgactccccagccacctttgcatgccctgcatgtgcagcttggggtgaagagagtgaggaacagaagagcagtgttttggggagggtcctggagtggcttcccggtggggtgggggcctccagcctctggctccaccctttgcccactcctcattttctctctcaccccaatctaggccgaaatgagttgattgcacgctatattaaactgaggacggggaagactcggacgagaaaacaggtagagagacggtttatgctgggcctgccacccacacactctgtctcagctgccccggtcaaccccttgcccctaccctgcccacctcctcgaggctgcccctgacctggactgccaccctccttgcctcatcacactccccttaccccctcgattttacaccctcccacccccaagcagctccattcacccttcccacttctcttggagagatggccccactgtcctctctgaccacctactaccctgcccagggcctgtggttcagggaccacagataagcccacggggctgctgtggctgctacatggtccctgccctgagtggctcactcaccagccagggagccagatggtcagatggatgggtacagagcaaggtggcggggctgagagagggtgggtgcagggcaccctgggacaagcagccaacccagacaaggctaggggagtggggagagagagctgggaaggctccctggaggaggtgacactcgggatatatttttaagaaggaatgggagttcgcaaggcagagaaaagggagaagacccttccttccaggctgaggaagttggatatacaactaataatcatggtaaacccatacagagcttcctttaagttaatttatttcatcctctcagtaaccttactagataggtacagtaattgtcttttttactatgaggaaactgatgcatagggaagttaagtaacttcttcaagccccccaggcaggaaagagctgtgcctgtgggcagcctgatgtggtggagggagggtggggactgctggggtaggggacactcagcaggagacatgggggacaggttccccaaggggcagcggtgggctacaggagggtatggagcagggagtgacaggtggcagctgttgaggaaggccctcaagcagccgggacaatggattagagagggctggctggagacagagaggctggccattgcgggcataagcagaggcctagatcaacagtgccagggcctgggatgagggtagtggtggtgggagtggagaaaaatgatgatgtaagagacagttagtggcttctgatccagggaaggtggcagtgtagtgacagaaacctgaaggggagtggatgggagtgatggccccactgcctgggggagaggccaggctggaggcgggacctggaggaatggaggccagtgctaccctcacactcccagcctcctgtcctggtgggatttggacccacagatccccatggtgcatatgtcaagtctggcctgttccacctctttctcaaaggaaggttctgagcctccctacccagtgtaggggtggcaacgatccctcattcattcaagcatttatgaaccaccctccctaagtctagctcatgcagcaccaaatttattcacttagctaatgattgacctactgctgtgttctaggcaccagggataccacatggaggcgtgcgccagagccctgtcccctggagcccttgggttcaaatactggttctacctgggagtgggcagtagttggcctcccagccttgcatcctcagccattgaattagttaacatgtgaagactcttagaacagcgtaagcgctgcagaagaatttgctgctgctgttattattattccagacattattataaacagaaagccgttctgagctcagaagcgaactctcagcgggtccttctctacccagaagaggtgttcataggaacctgttagtcagagtgggaacgggccaagggtcactaggtcactgtttttttgttggtttttttaagttttataattaatataaaaatggggtctcgcgatgttggccatgttgttcttgaacttttggcctcaagcagtcctcccgcctcagcctcccaaagtgctaggattacgggcacgagccaccacatccagccaagctgggtcactttgaactgaggccagggtggattgcagacgtggggcacatcccagcccctgaattcagggtccaccatcacacctgctcctgcctagcatcctgagagggctgcccagaaaagagcttttacaaaccagctgttgataagctcagaattttagaaaccactgtcttcattataagggcataaggtacaaggatgaaactccccctgtctttactctttcttagaactctgggtttttacatcccagtgaaaggggatctgtcctctggttgtgaggacaaggcatgtctttatgtgttaaaaagagtaaccactgacaaggttttttttgatccttttaaaatttactttcgacctgtaatcccaggactttgggaggccgaggcaggtggatcacttgggttaggagtttgagaccagcctggtcaacatggtgaaaccccgtctctactaaaaaatacaaaaattagctgggtgtggtggtgtgcacctggaatctcagctattcgggaggctaagacaggagaatcgcttgaacccaggaggcagaggttgcagtgagccgagatcacgccactgcactctagcctgggtgacagagcgagactccatctcaaaaaaagaaaaaattacttttggcaaagaaatgcagttttaggtttttacagatacacacatgcagcaattcgtagtaagcacaatgcctccatatggacaaaagagctaaatattaagttagaatgaagctctgtgtgactttcagctgttacagagtcaaccatctggaggcagtcttctgagctaagggtccaagtgagtcctggtaacggagcttggtggtgagtggagtcagagtgggctctggagtcagaccgcctgggtttgaatcctggctgtagcactcagccgtgtgacagcttaacctttccaggctttagtttcgttatctgtaagtcagggatattagtacctaggtttttgtgttgctgtaaagatcaaggggtcagtatgtataaatgcagaggacgatagtatctgtgctcagtaaacgccagttactgtcacagcgtgaagtggtcagtaattttgctggacaggagtctgattcctgggctcagtgaggcagtgtgaggagcacccacccaggtcctaaccaggtggtatcacatacttactcactgtcaggctgtgattaaagagaaaaacgagctttctttgtgggagtaaaaacaactcgcaaagaaagccaattgccaatgctgaaagcgtgaagcggcgtcaaggatctgtgtgtttcctggggaaaacagtgacatttgggttctctgtgcctctgggtcagatctttcacaaggtcaagggtctgtggtgtcagctgggcacacagcccagggcacacacatccagacagtgattagctcaagtttgcctgcggaggctgcgaggaggagatggctagagaagaattgcaattaagagcacccactgagtacatatatacacactagcatatattagcccaagcagaaagaaggtatattggggggaaaagttatgggagcaaagcaggagggccaggcctcgtttcataggctggggctgtggttggggttgacaggaggactcaggcggtggtacccgggagatccctggtagaggatgtggccttggtgtataagctagtggccaacaggagcaccatggccgttgctagcacctgtggtgccaataagaaaaaggttgtctcctctgaggacaccagtgagaaaaagtcaccctttttgcggggaggacagggttaggcacagccttgtacaaggacacatagcttgggcagcagaacttgggctggatttcagccctcactggtgccctttgggccagtgaacaacctgtgcagctgtacatggtggccctggaagccactgtggctcttgatcatgataagaccaaaaagagaacagaattggcagtgtcaagaggtgtctgaaccgggcacaatggcacatgcctatagtcatagctactcgggaggctgtggtgggaggatcgcttgagcccaggagtttgagatcagcccaggcaacataaaccctgtttcaaaaagaaaaaaggtccccccatttacatgtagttccctagagatgagaggtctgggatgctccttgcccgcggccaccccatggctgtgcctcctcactgtctatgttttcctctctggcggggcgcggggcggcccctaggtgtccagccacatacaggttctagctcggaagaaggtgcgggagtaccaggttggcatcaaggtatgttgggtgcctggcgggggccttcagccctcctgggcccctcacccacggcgctatctctgcatagctcaggcctttccttggccagctctccagccccactgtgcctcttttctggctgaagctctgtttctgcctctccttccgctctttctgttctttttctctttctttctctctctacaggtctctagccacttgcaagttctagccaggcggaaatctcgggagattcagtctaagctgaaggtacggggcccctgccacctggcctggcctgcccagcaccctcctgggtgcaggcctgtcgctgctctgtggctccagcctgggacaggcaaggggctgagaagctgtgagggggtccagaaagaaacacaagtggcagcaggaagcccaagggccctgtcagtgagggagagggagaccatctgggggccactaaggcccacccctcctcttctctgtttttctttttctccttcttcctgactgctgcttactaactgcatggggacttccgtgggcagggaggaggccccggggctactggccggcagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggtaagtagcacagccctccccagtgggagtgggggaaagggtcttaacacctaatacaggattttcaaatgacagattatgaaaccaacttaataggtgtgcaagcctcattttaaaaaaacgaaatggctgggcgtggtggctcacgcctgtaatcccagcactttgggaggcagaggtgggtggatcacaaggtcaggggatcgagaccagcctgaccaacatggtgaaactccgtctctactaaaaatacaaaaattagccaggcatggtgacgaatgcctgtaatcccagctactccagaggctgaggcaagaaaattgcttgaactcaggaggcagagcttgcagtgagccgagatcatgccgctgcactctagcctgggtgacagagcgagactccgtctcaaaaaaaaaaaaaaaaaaaagaaaataggagagtacatgacatacagtaagaggaaatatcttgacatatattggcctttggaataaaataatttcttactgtggttgtggtcagcggtgatgggcacttgggggactgagaccaggaaggtgcagagactctcccaagatcacacagcagagctggggctggaatccaggcctggatcttcaggaacacctgccatcctagtgctttggactctgctggggtcatgggaggggcgctaaagcaagcctggcctcatccagcgtggccctggcttcatgcagcctcctctccccaggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcgggtacatgggtcccaggaggtgggctggtgtgggggtgtgctgtaaaggatgagctttagtggggttcatggatgctgaggggcccctgggccttgtctcatccctgcagttctggagcagcccccctctcctgggacagcagcctggaccctctcaggagtgagtattgtggctcatcatcccacgccctcttcctcctggcagccgcacagggcttccctcccatttgggctccagcaacagctgagcaaagttttaattcaaaaatagagggatgcaggctgggtggtggctcacacctgtaatcaatcctagcactttgggaggccgaggtgggaggattgcttgaggccaggagttcagaatcagcctgggtaacagggcaagacttgctctctcaaaaaaaaaaaaaaaaattagctgggtgtggtggtgcgtgcctgtagtcctagctacgtgggaggccaaggcaggctaggattgcttgagctcaggagttccagagttccaggctgtagtgagacttgattgcaccattgcaactacagcctgagcaacagagggagaccctgtctctgaaaaaagaaaaaaaaaagctggagagtggcaacaggacagctgatgcgctggctgttcactatgcattctctcatcagcatgcatccacttgtcatccatctctttgtttactttctgctcagtttctgaggcagtctctcagttaacaagtcaggtggtcaagtgtgctggttcttcaactctaaaacaactttcatcaaaagaccctcagcttaaggagcagcttttcagggtggggggtggggaaggttgaaatgaaatcctacactaaatgggcagatcagctgggagacgcagcaggatttcacaaaagctaaaatgtgcagaaaacaaaaagcttgcgagttagcttttcagcatgcgtttctgggcctcagcagaaaggctgggtggcttgctcctggggtcttggaagaggggctgggccaggtggaaggtagggaagagggaaccctctcaccaggctgtgctcctgtctgcagcatcaagccctttgcacagccagcctaccccatccagccgcccctgccgccgacgctcagcagtaagttccccacacgaggtgctctcccttggcacctgcacctccactcaggagagctggggtccaactgtgtgtgtttgctttgggagggagggggttgcgacatctacaggagattgggacaggccaggaatagcccctttaccttgtacaatgttgcttccagatctctggcacaaaaccatagccaagccaggcgtggtggctcatgcctgtaaccccagcactttgggaggctgaggcaggtggatcacctgaggtcaggagttcgagaccagcctgaacaacatggtgaaaccccgtctctactaaatacaaaaattagctgggcgtggtggcgcatggctatagtcccagctacttgggaggctgaggcaggagaatcacttaaacccagtgggtggaggttgcagtgagccaagattgtgccattgcactccagcctgggcaacaagagtgaaactccatctcagaaaaacaaaaaaaccatagccaatacacagctacaagcacacaccaccaaaacctacatttacacacatctctatggatagaaaactccccataaggaaatgcactgaaatcttaacaagactttctctttctagatggtgggattctgggtaattgttctttcccttttttacttctctgtgttttctgtttaaacacacaaggaaatgtttttgatatatactactagggccaccacgtatggttgtgcaggttgtacactgtacaaggacacatagtaggggagtcaaaatccaactcatgttccttcccaaaaggggcacctttgcaagctgggggcagctttgtcagtaagcacctgcatgcatccatgcagatgaaaatctgtctcgccctcccaggttatgagcccctggccccgctcccctcagctgctgcctctgtgcctgtgtggcaggaccgtaccattgcctcctcccggctgcggctcctggagtattcagccttcatggaggtgcagcgagaccctgacacggtaacgtgtttgggggtgagggtgaggctttgcacaattgtggagaggccggccgggtgatccagggctgcaactcaggatctgggggttgggggtctggcctgttcaggaagccctaggcaattctatacctgtgcagtgctcccttccccgcccccgggcctgcaagcctgagtactctcctgaccctgtctgggccctccccacagtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggtgagtccccctggccttctctgctccaagcccccttccccaccccagaggtgcaacatccaggcccactgcattgacctctgaccctgctgcatcctcatggcttgtgggcagagtgccagagatggatccttgggcaggactctgatgtggtgtggcgggaatacttctggtctctgccagcacctaacaccccccacccccatgcccaggccgacctcaacagcaccatccaggagggcccgggagccttctatggggtcagctctcagtacagctctgctgatagcatgaccatcagcgtctccaccaaggtgtgctcctttggcaaacaggtggtagagaaggtggaggtgagtgggggctctgggtggcttggtggggctgggagcaggcaggccgagtgacgccttctccatattctctgcagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtatgggggcagcaggggtcgtggggagtcccacaggccagggcctccaagttgggtagccagacacatcgcttggctgagaggcatagatccggaaaggagaatggtctgttcagccccctgccccgtggcccttttctccctgacctcctgaatctcttacctgctcaccccccaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgtaaccacttgtgtgccagacctttggattggaacagcttcaggtgagggctcctcctaggtcctggtgtgtcatcaccgccaacccctgcaatgccatcatctcttggggggccccaaggcctacccacactcaacatttccctcactccctcctgcttccagctgagcacttgtgtgtgctggcctgaggtcacctaagggaagtgatgtgctcaaggtcgcacattgactgagatggaagctccagggccccctgataagccagcacaacacagaccaaagcctaggggttagcaactgaccctaagtgactcaaggagggtaagcgctctccccaggtgacaactgctgacctacccatgtctgcctggaaagccctgctgtcctgagccacctgtccacagtagggacagaccacagtccttagagggctggggcagagatagttcaagactttcagcggccgggcacagtggctcacacctgtaatcccagcactttgagaggctgaggcgggtggatcacgaggtcagatcaagaccatcctggctaacatggtgaaaccccgtctctactaaaaaaaaaaaaatgcaaaaaattaggcaggtgtggtggcacacgcctgtagtcccaaatactcaggaggctaaggcaggagaatagcttgaacccgggaggtggaggttgcattgcagtgagccgagattgcaccactgcactccagcctgggtgacagagctaaactccgtctcaaaaaaaaaaaaaaaaagctttaagcaaacattttcccaaagaggctgttctagctttttctcctgcagttaaatatgggtgaactgattggactcacttgtcacaggatgaaactgtatttgctctaagggtggcaggctagagatgagactctagaataaagggttaaacagaatggggatgacccagttaaattttaatttcagataaacagatgatttaagtatgttccatgcaatactaaggacatcctgcatttttatttgctaaatctggcaaccctctagaatctagtcttctaggtcattctagtccaaccttcaagttaacagatcgggagaacttgagacatgttaaatgtacttctcacagccagtcactgccaacatcaggattccaacctggtctgcctgactccacgttgtgtgcctggtatcccactaggagccccaaactgtcacctgctggatgggtgggagggtaccgagccccagtaggtaggaggggtccaggaagcagaaattcctggaggctgcactggacaccgattacatctgtgggcgattagcacacgagccttcagataattgcttttgctttaagctgaagtttcccttttccttctgattgcaaagatcacaggaggttcagaaaatacagaaaagcccaaagaaaagaaaaataaccacaacaagtagctggctggacctgtcttgagaaccaaaattcactgctcatcctcattaggttttatacctttcttaccaagaaagtgctgttaacttcttaaaagctaaaaaagcaaaagctgctcagagtaaaaaccctgtgttcttcatttcagggacagggaaggcttgttttgagaaatgcagcatctcccccgaccccccgactcccacacataccaccgatggactcttgctgttgcccaggctagagtgcagtggtgcgatctcagctcactgcaacctccacctcccaggttcaaacagttctgcctcggcctcccaagtagctgggatcacaggcgtgagccaccgcacccagccaaaatacagcattgttaagcactgcttttatgctttaaaataaccgttctcagccgggggtggtggctcacgcctgtaatcccagaactttgggaggcccagacgggcggatcacaaggtcaggagatggagaccctcctggctaacacggtgaaaccctgtctctactaaaaataccaaaaaactagccgggcatagtggcgggcgcttgtagtcccagctactcgggaggctgaggcagaatggcatgaacccaggaggcggagcttgcagtgagcccagatcacgccacttatactccagcctggggaatggagcgaagactcaaaaaaaaaaaaagcagggatgaacttgttcccctatttaccaaagtcaaactaagctcattttagtcaaaggttaaagcagtactgggtgctagaggcaagaactgccaacagggaaatgcctcagaaaaggagggggcttagcctgcctggggcaaggacctggaatactgttaacaggatctggctggggatggtgactcacacctgtaatcccagcactttgagaggccgaggcagaattgcttgaactgggacccacagattgagatcgcaccattgcgctccagcctgggctacaaactccatttaaaaaaaaaaaacaaggtccattaattatacttttgtactggtttgctgtgccttgttttccttaacatttactcattactaacccaaagcataggatactccacatgtggtcttcttaacacagaaatgctgactaaaatccttattttaaatttacatggaccaatcctgtcaaaaagcttcaatgccgttagcaaccctatcacatatgcaagactgcctgattttgatggcagaaaaacatcctcttccctatagtacccaactatccatcatcaaagtgacaaactacacaactagccatcagcagtgccaaggccctcacttgtcagctgacaaaccaccccccaccctcaatcacaggcagacagagggaactggtaatagaatttattcaaatgtgccttaatataggcgctggggcttgcccatggtgctcttgatatataaggcccggacattctgccagtttttcttgagcaatgacaccaagaagttgacagccaggtgaatgttatacacaagctcatcgtctgtcatcttcacgtgaccaacagctacagccagacataacacctgggaggagggaagagaggatcaagtcaggttggtggacgaatagcagatggcctgtccttcctcccccagtggcctggtgagcaggtacttggacccgggccaagaccagggttactccaaaagtttcaatcctggtgggtgctcttactggcatatttagagacttggataagatttagaccctgccaacaccttcacccatagcaacccgccagacccactcaccttcttcatttggaacttgattgtggacttcacctcatccactttggccaccatgttttcgttgtgtgtgagcagggaagggaactttcctgccttatttaaacctgggccgaggattcgtggaatctgcttgatcagagactctgaggccaaaaacgcatcatacttcttggctgatagagagaggaagccattggcattgcttagaacctggtcaccaaggcacacctcaaatgtggcaggccagaaacgcacttgaatcaatcatgtaagtgacctccaagcagcaccctctctaagaccccgcctcagtcttttccctagcccaaacggtttccagaaagtcctctggaccttcactggtcccaaaacatgctctcagaaaaccaggctgacccatgatccatggcataaccgctgtacaacggatgctctggtcaagactgcctgggctcgaattctgcctatttcttagctgtggaccctggacacgtgacaactgggaatgtctgcttcctacctgtaaaagcagtctaatgccactgcctaaacaacgcagcgtaaagatttccaaatcatagttcaccagcacctggctggtcaacttacaatgcctggcctccctcatcaactggaatcctcatagcaatacaaacatcaaaccaccccaaagctaaaacagcactcaggcaagctaggcaaccaccgccgatcctttgctattctaggcccctcatcatttaaaaatcgaaaatggcagaaaagcctttctaccgcccccaccacacatctcacatgcaaaaccacagcggccggactcacccagcttcttgaccagttttttattcttgttgagttttttcagcgcctcgatgtccatgtgggggatatccacggccttagcctcgtcacagtgctgctggtcccccaggacacacacagagaacttagggcggggagtggacttaagcctgcgttttgggggacagcaccaacaggttacgcctagccctgggtcccaagggccggtgaagggtctgggaccgcagcagccaccgagccttacccggagcgttcacattcaccagcagccagcctggcttctcaggctggccggcgggctcggccgaggcctacccacgcctcccctcatgttttaagacccagggtgggggtccgtccagccgcgcctgcccggagcagggggtctgaactaccctagcacatcagtaccgacgtgcccgcctccggctcagcgggagcctgcaggggaggggcaagcacgggggcactgagggctgggtgggatcagaacggtgccaacctgacggtgcccgagaagcgcttgtccttctggggatcatagttcttcaagctgatctgcaactccaccgtctccaggaaccttcgagagaggaggggggttaagcacccgccggccctcgccacccgcgccgtgccccagggtcggcactcacttgcggcgcttgcgctggttcccgtgcaggacttcccgcaccgcctcgtacagggtgtcgcgagagactttgctgctgcgggagagaagcgacagggcgctcagggccgcggagtccacacgctcggactgcctggaagcctccgaggtctaggcttcgagacgggcgggcggcccacggcggactcccccgtagattccggacaccaagtagagcgacgggagctcagacccagacccaagccccggtggaagagggaggctctcagtgatcggacctggtaggaagggcgacccgcaggccgacccgccttgagaaatgccccgcggcgcaggtggcgcaagggtccgcggcgcggcctacaggatccgaaccctcggcggggcacctgaaggcgcggatgaacgcggatagggctttcaggaccaactcacctcatggcttctcacgccgcgctaaccggaaaagagactagcatgtcttgcgcatgcgctcaaatagtggccctgatctcgcgataatgctttgctcctcggtcctacccgcagagcggttgggtgggccaaccccgagaagcgcggccttctctggccgctggggggcgtcgctgggccgctaggccggcgcggtaacccacagagttgtcgcagtcctgagcgccccgcggtcccccggtaatgtgccgattcgcgcccgctgctgctggacccctagggaagcggctgggttcggggctcgagcttcggtagtcacacgtactggtacagcccagtgatgttcactgacagcgtggattccggcacgcttgtccctcaaacccctctcccctcgcgccctccgcaccagcttatgttctcaaaaggaagcctggcccgacctccctccctcagcaccttgctctaacgtggactcgtggtaagggaagtgtccggaaagttctgttcctgtcctttcaacgcctgcagaggggaagagctgggaaagtccttaagtgaactttcacttgatagttaatttgataacatctacgttttaagtgtgactgctatgaataaggcgtctagccaggtgctacaggaatacaaggatgtaaaacaggcacacagcactgcacacccataaggtgtcttctctgctctttcctctgtccaatgggtctcatcctcttagccacagtaacccccagagcccttcagatctctcctcggattcatctgcccaaaacccttcccgaactccagactgagtcactcccacctttaagatgcccattctcacctacccccctgcctggtgggggcagctcctataggatggggtgggtggtattacacattatttggccctcagagggtgaataagataccctacacccttcccctcaccaggaaaaagatgttccttgtcattgagcagggaagtggagggggtgcggatgggctcaatacccagaattcatgggaaggaaggtactgcttctaataagacattggccaggcgtggtggctcacgcctgtaatcccagcactttgggaggcaggcggatcacctgaggtcaggagtttgagaccagcctcgtctctactaaaaatacaaaaatgagcgggtcatggtggcatgcgcctgtaatcccagctactcaagaggctgaggcaggagaatcgcttgaactggggaggcagaggttgcagtgagccgagatcatgccattgcattccagcctgggcgacagtgcgagactcagactcgaaaaaaaaaaaagaaaaagacattattgaacttgcttttattcaacaccattgataaattattcaagtcagaaacaaaaacacagaaggtcataatatacatgagcacaagagcttcatctgagcccactggtaccccagacctcctggagcatcccatgcccactctgggtcggcttgatcctactgagccctatcggaaagtttgtccctgcagcctgagaattgatgaggagtgtgcctggggccagcagcctttggaaatatagctctggcctggtgtggtggctcacacctgtaaatctcaacactttgggtgccaaggcaggaagatcacttgagctcaggagttcaagaccagccctgaccagcatattatctacaaaataaaaaattagctgggcatagtgtcatgtgcatgtagtcccagctacttgggaggctgacatgggaggatcgagcctgggaggcagaggttacagtgagccatgatcaatcgcatcactgcactccagcctggatgacagagcaataccttctctcaaaaacaaaagaaatgaaaaagaaaatatagctgagctcccttagcccaggagcctccctgctggctgggaagccaatattccctatgcagcctgtaacagggaggcagttgcaatctgggatggccaggctcagcctttatcctcaggctagggctcaagacaaggtggtgaagaaagaaatgcccttcaggaagctggtgatggagcaccaagagggtggtcccttggtggatggtcaggggcccaaatgtttcaaggcggccttcagggacttcctcaggaaggtggtgttaggttctagggccatagccaggcccagcctctgggtctcagtgatctggggagaaggaaaaatcatgtcaggactccagcaactgatccctcccgtctcccgactaccccaggggctctattgaggagagaggaggccaggaggatggaaagaggaggagactcctgagcaatctaatctcattatttcaccatggttaacgaggtagacctggagccaaatactagctgcacaatttactaagccggccacattagtaacagttgacaatcattgtgtgtttactatgtggcagcactttatatgcatcaatccatatacaaacatacatatacatcatatatatgcattgctgtatataatcctcaagaccctcccattttacagaggagaaaactgaggttcacagacactctactgtgacagctaccttccttttggatcacactttctctttctgccctgttgctacaacctcctgacaggtctcaggccctgtatcttcaccctccaatcccactcctcacagaagccagatgcttcttaatagtacagatctgatgaagttactcccaggttgaaggcccttgaatgactcctgatgcctcacattggaggtccttctgcctagatctccagaggattcaggagctcccctgaaactgtgcaacagaagcatgttcatacttccatctttctgggagggtctacatcaaatcatcaaatgggcctgtaacacccccgacataagggtacaaaggcaatagcccagaatacctgactttcaagataaagttaaaaataaagctcctggctgggcaccatggttcatgcctgtaatcccagcactttgggaggccgaggcaggtggatcatgtgaggtcaggcattggagaccagcctggccaacatattgtgaaaccccatctctactaaaaaatacaaaaactagctgggcgtggtggcgcacacctgtattcccagctacttgggaagctgaggcaggggaatcacttgaacccaggaggcggaggttgcagtgagccaagatcgcgccactgcactccagcctgggcaacagaccaagactctgtctctcaaaacatacatacatacatacatatatacagctcctcaccatgacgtacagaaaaaatgctactagtcctggcagtgtgaccttgggcaagttactttaacctgtgtgagtctcaattttctgatctatgaaacggaataataagaatatctctcaggccaggcgcggtggctcacacctgtaatcccagcactttgggaggctgaggagggtggatcacaaggtcaggagatcgagaccatcctggctaacacagtgaaaccccgtctctactaaaaatacaaaaaaaattagccatgcgtgctggcaggcgcctgtagtcccagctactcgggaggctgaggcaggagaatggcgtgaacccaggaggcggagcttgcagtgagccgagatcgcagcactgcactccagcctgggcgacagagcgagactccatctcaaaaaaaaaaaaaaaaaaaaaagaatatctctcacagggctgacacatggaataaactagcaagttcatatatgtaaagggcttagagccacgcctgaggctgggtgtggtggctcaagcctgtaatcccagcactttgggaggccaagatgggaggattgcttgagcctaggagtttgaggccagcctgggcaacataagaagaccctgtctcggccgggcacggtggctcacacctgtaatcccagcactttgggaggccaaggcggacagatcacaaggtcaggagatcgagaccatcctggctaacagggtgaaaccccatctctactaaaaatacaaaaaattagccgggcatggtggcgcgcgcctgtagtcccagctactcaggaggctgaggcaggagaatggcgtgaacccgggaggcggagcttgcagtgagccgagatgcgccactgcactctagcctgggcaacagagtgagactctgtctcaaaaaaaaaaaaaaaaaaaaaagaagaccctgtctctatttttgaaaaattaaatttaataaaagaaccatgactgagacatggcaggtactgtagaaataatagctcttagtactttagctctctaatcttatcccccaccaccatccattctcacatttttaggctccatccacaatgaactacttgcagatcccctcagacactcactgctcacactgtatctttttcctgaaatgcccttcctctcatctctggctcttgactaccattcaccttttaagagtcaggaagtctgggcacgacagctcacgcctgtaatcccagcacttttggaggccgaggcgggctgatcacaaggtcaggagttcaagaccagcctggccaacatagtgaaaccccgtctctactaaaaatacaaaatatacaaaaaattagccaggcgtggtggcaggtaatcccagctactcgggaggctgaggcaggagaatcgcttgaacctaggaggcagaggttgcagtgagccgagatcatgccattgcattccagcctgggcaacagtgcgagactccgactcaaaaaaaaaaaaaaaagtcaggaagcccgtcccaattcccaaccacaaacaaagctcacttgctcctcttcttttgccaccaaatgccctttgcacacctctcacctggctcctaccagatcttacttctaatatctgttatctgtttattttatttctcccctctcactagcctggggttaggtgacggggtcaactcaagggcagggattgcattatggtcgctgttgatttcccagtgccccacacagcatctggcctaaagaagtgttggctggatgaatgaactcctaagcagtctcattccccagtcctgggcttgaacttgttgtttctctggctagcactcagggtttgttttttgtttttgtttttgtttttgagatggagtctcactatgctgcccaggctagaatgcagtagcatgatctcagctcactgcaacctccacctcccagcttcaagcaattctcctgcctcagcctcccttgtaactaggattataggcgtgcaccaccacacctagttaatttttgtatttttagtagagatgaggttttaccatgttggccaggctggtcttgaactcctgacctcatgatccgcctgcctcggcctcccaaagtgctgagattacaggcgtgagccaccgtgcctggccagcactcagggttttatccctgacatacatattcatacacccttgtggcaggcccagggcagccctgccagcaggaccagccccaaggccctatcaatactcacgttagcctgatacttggtcatcactgtcagcatgagcttggcataggccatggaggtggtggctgccagcccctttttacagagcttctccattaagacactgaacttctcaggggtcatctccacctgcacacattgggagatggagcagtaatcacaagaaaggcttgggctcttcattcagccagtcctggattcaattcccaactccaccacttcctagctaggtgaccctgggcaggtaacttaaccaacctaaacctccatttccatatctataaaatgaggctcaggatatctaacggaagactgtgaaaaggattaaatgagataatgcacataagacacacaggtctcagaaaatggtggctaccattgcaaaggctcagattaggaccaaggggaagccaaggatccctcatctggttcagtggttaaagatataaaggacccagggcccaagagacactgccaccttaatcacctgtctctttataataataatttatgctaggcacggtggctcatgcctgtaatcccagcactttgagaggccaaggcgggtggatcgcctgaggtcaggagttccagaccagcctggccaacatggtgaaatccgtctctattaaaaatacaaaaattagccgggcgtggtggtgcgtgcctgtaatcccagctactcagggggctgaggctggagaatcacttgaacccaggaggtagaggttgcagtgagccgagattatgccactgcactccagcctgggtgatagagtgagactccgtctcaaaaaaaataataattattattattatttaataaacactgtgcatcaggtaccattctgactactttacaccaattatctcatttaaacctcactccagtcttatatggtaggtgctattaatattatatctccccttttgtagatgaggaaaccacaggcataaagaagttaggtcagggctgggcacggtggctcacgcctgtaatcccagcactttggaaggccgaggccggtggatcacgaggtcaggagatagagaccatcctggctaacatggtgaaaccccatctctactaaaaatacaaaagattagccgggtgtggtggtgggcgcctgtagtcccagctactcgggaggctgaggcaggagaatggcgtgaacccgggaggcagagcttgcagtgagctgagatcgcaccactgcactccagcctgggcaacagagcgagactccatctcaaaaaaaaaaaaaaagaagttaggtcagttatctaagatataaacaaatgaggcagaatttcaggtactgatatgaaaaaaatcaccaaaatatactgtgaagtaaaaaaagcaacctacagggcactgagtttggtgtgttgcaatttccaaaaaagtaggagggaaagtaagagtagacatgtttccacatatagatggtatctctggaggggggcggattcccctgaaactggtaatactggttagccctaaggagggaaatctggatggttagggaagagaagtaaggggaatatttttcactgtatccttttgagcttttaaaattgtgaacatatgggctgggcgtggtggctcacgcttttaatcccagccctttgggaggtcaaggagggcagatcacttgagcccagaagttctggcctcaagtcatggtgaaaccctgtctctactaaaaatacaaaaattagccggtgtggtggcgcacgcctgtaatcccagttacttgggtggctgaggccacaggagttctggcctcaggtcatggcaaaaccctatctctactaaaaatacaaaaattagccagcgtggtggcgcacgcctgtaatcccagttatttgggtggctgaggcacaagaattgcttgaacccagtaggcagaggttgcagtgagccaagattgtgccactgcacttcggcctgggcaacaaagccagactctatctaaaaaaaaaaaaaaatttgtgaacatatgaatctattacctattcaaaaataaaattaaattcacacacacacatcaaaaatcccacccccaaggcccccccagctggtaagaggtggagctgaagtgaccatgtgctcagctctctgctaccagctttgcatggcccagggctctcccactgtctcaggcagctgctgtagggcagctgtcctgcttgaccctccatgcactgaaggactcagaaacccaggaaccccgtgtgcttccaaggactgcagcacttctttgtccactcttccccagggcagcctgctcacctgccgctctaggagtgactgcaacaccaagaaagtttcctccttccagggcagctccaagatctgtctgcaaagcagaggccctagtgaaaaatgcctggcctcccacccaagcctgagtatctatctgctgctccaactcccacagcagggcaaggccctggggacagccaagatccccagccaacaaaggggtagtcaggggtggggcacagtggctcacacctgtaatcccagcactttgggaggccgaggcaggtggatcacctgaggtcagaagttcaagaccagcctggccaacatggtgaaatcccgtctctactaaaaatacataaaattaaccaggcttggtggtgggtcctgtaatcccaactactcaggaggccgagacaggagaattgcgtgaacctgggaggcagaggctgcagtgagccaagactgtgccaatgcactccagcctgggcaacagggcaagactccgtccccaccccccaccccccgccaaaaaaaaatgggtagtcagagccttcttgatgctggcaccagccccagcagccactgttgcagagctcatacaactgccagggaggtcacaacctcaagagccccaggagctgacaacaaagtatttggtagtgagacacaaggatcccctaaaaaataactaggagtagaaagtgcatcgtgagaacaaaaggcaaagaggactcataaaggagaaagaggatggagtgagatgatacacataaggcttcctagagaaggtaagccttccctgcagggcccaacacatgtgatgtcactctagcctgggggaacaggtggcagtggggacagcacggaggcctgcacactcaccccagcattagaacctgtgcatctggctccagggactccatcttcacaaggcaacacagtaactctgtttgagcaggacctgggtagaggacagcagaaggggaagtctggggggaaatggcagaagacagcagaaagcagggaggcggtaacagaatgcccagcctgttacaggggcattgtcagggaagcagcaggcatctttaatcactgaatacccaactcctgccagggccactctggggtgaaggatgctgagaacactgagggcagagctactgggcctggggctggttccagaattacctgtgcctggggcctggagcacagggtcaaggagggcgctgcagacagggtatgtatatttggcacagaaggaggtcagggcagttgtaagcaggcgggaggctgaggaagtcaaggagaggatctacagccaacagggaggaaaaaattaattattttcttcttcatttcaacagcatttatcaaatgcacatttcagatgatgatacatgttacaaaggaaaaaaaaaaccaagttcttttatttagaactcacatggacccacccattggaaaagatacatacctctcttgctcagttcccaaatccctgaaagtcccttgatcagcttctagaagggttctggtgcccaaagagaagttagatgccagctgggcatggtggcttaattatgcctgtaatcccagcactttgggaggctgacacagctggatcacttgaggccaggagttcgagaccagcctgggcaacgtggcgaaacccagtctctactaaaaatacaaaaattagccaggtgtggcggtgggtgcctgtagtcccagctactcaggaggttgaggcaggagaatcgcttgaaccccaaaggcagaggtcgcagtgagccaagattgcaccactgcactccagcttgagtgacagagcaagactccgtctctaaataaataaataaataaaaatacaaaaattagccaggcatggtggaaggcacctgtgatcccagctactcaggaggctgaggcaggagatcacgccactgctgcactccagcctaggcaacagagtgagacactctctctcaaaaaaaaaaaaaaaagttagatgccatgtgggtagatggcctgggggtccatgccctgccagttaagcaggcatcctttccttgccccaggctgcccaaacagcccagatgtctacaaggctgggaatcccctctctcaagtaccacccttctgagggcccagttgctcttccccattgtccttggcactctgagtacctcccaatacacctacccgtccaagaaagaggcttctggtcagcacagtagcattgctgaggctgagatcaggtgaaagggccagcagccaggtgcagagccgcaggagaccgaggtctgagagctgagggagctgcagctgggcacacagcaagtccatctgcttacagagtgcggggggagagaggacaccgggacatgcactctgcctctgctaggctgtctcaagcaactggacagcagacagagcagggcaaagatactccagggcaaagaaagtctgggagagctgccctaggggaaggaaccaagggctaaaagatactacacagggtgacccctatcgctgagagagaaaacaacaaaatcccctcccacatttcccacatgaggtaggaaaacataaacttaaatagaaaaagataagggacagagaatgtaacctcagagccaggcagtcatctggactcacctggctgggactacattcgtgaagaagctgtagctcaactgggggggcatcctccaatccctctaacccctggggagacaaatctcatgttagggctggcagagccctcagtgacaagtcactgaagccaccccttcaggtggcagaaggagtggcctgagatcctggaaggcactaccagagaagaggaagttacctggggttagatggtaagtctacacttggttcaagaaaagctccttcagagactgtcctcagacctttactccagtccccctcccccagccagcttgtatatcactgcattgggccttccttgggcatagttggggtctgggtagaagatggaagaaaggctatggtgagcactgtggggccagtcacctcctccaaggtcttcagcagctgctgcagcctgggaagctggtcctgtggaggagagcccagtcactgctacgtccctccccctgcagcatgaccccaagcccggttctggctccccctactgaaaaggccccaggtcagtgggagctagctggcaaagatgattcaagaaagtcaagaggccaagcgcggtggctcacaccagcactttgggaggctgaggatggagaatcacttgagcccaggagttcaagatagcctgcacaactagttgagaccccatctctacaaaaataaatataaaaaattagccaggcgtgatggtgcatgcctgtaatcccagctacttgggaggctgaggcaggaggatcacttgagcccaggaggtcgaggctgcagtgagttatattcatgccccttcaccccagcctgggggagaagagagggaccctgtctcgaggagaaaaaaaaaaagtcaagaacatgaagtctctatcttgaaaagtgcctaagaacccaaactagacaaggtccatgtgaaacctagctgtctagaattgtcttctgcatccaacccaaatgggggtagacccaggcctcagactaggaggcaggggcagactggatgctgtcatgattcttcccacccacatatgacggggtagcaggggtggctccagagcctctcccttgcctggcaccctttaaccccacattatagatcattaggacacatttcccacctccaataactcccttccctacccctccttaagagtctgtggagtggctgggcgtggtggctcacacctgttatcccaacactttggaggccaaggtgggcggatcacctgaggtcaggagttcaagaccagcctgaccaacatggagaaaccctgtctctactaaaaatacaaaattagctgggcgtggtggcgcatgcctataatcccagctactcaggaagctgaggcaggagaatcgcttgaacccgggaggcagaggttgcggtgagctgagatcatgccattgaactccagcctgggcaacaagagcaaaactccatctcaaaaaaaaaaaagagtctgtagagtggaggctacattccctcaaccctaccttcctccttcttcctccaggaactacagtcaactccattgggaaaaagtgtcccaagcagccttccccatggataaagccaccactgctgaaagatcactctaaacccagtctccctaccaaagtacctggatagctttgggcaactccaaactctcagccagacctttagcatcatccagattcgaaccgtcctcgccagtcttaactgccatgacaggctggtccttaataggagatgcacttcctccatctgccagggattccagtgacttatgttcgggtctctccttctcatgatcttcttcctcttcccaacaccgtaatcttttggggaccctcttcccctcaggactggcagcctcttcctctgagtcctttctgcgtttcccaggctgctgggagtccctgttctcctcttcttcagggtctggagcctggggggatttcaacctcctgccccccaggcccagccccctacatagactttggagctgtctctggcatctttcagacagtggagaagctccctccatggaggtccccacccccaaatcccttcgcagcaattcccccagggcacggagccaggcatctgggtcaggggctaggtcctgctgggcaatctgcagcacagagaggagcccactttccggcagcgatggccgaacggccatcagcagggacatcaggttcctctggcatatccggggcaatcgcagcaacagtggtttcctgggtagcagagggagagcaagcagttaagtgtttggctgaagggagcacaaggcagactgggcagagctgggggctagatggcggtggacagatgggggctggcacgcagtatctgcaagagtcagtggatgttggccaggtgtggtgactcacacctgtaattatagcattttgggaggctgaagtgggcagatcactcaaggttaagagttcaagacctgcatggccaacatggtgaaactccgtctctactaaaaaaaatacaaaaattagacgggcatggtggcatgcgcctgtagttccagctactggggaggctgaggcaggagaatcgcttgaacccgggagtcagaggttgcagtgagccgagatcatgccactgcactccagcctgggcaacaatgtgagacactatttcaaaaaaaggaaaaaaaaaaaagtcagtggatggagacagggacaacatgaaagatgagaactgttcaagtgttcattgaatatctatcatatgacaggccctattctttggcctctgtcatctgtttcagctcaaaattcatattggaacctactctataatagattcatgcttgttttacacaaaagaagaaaaaagttctttcccaaattttaggtaaaaataatactccaggatgctgtgcagtgcttagtcttgcagccctatggctgccctcggcaatcccctggaactctcggggtcagtcatctgtccagctcttgtgttcctttcaccaaattgtgagttcctaaaaggtgaaggtagtgtttccttcctctgtgtcctaggactcagcacagcgccagcccagagcaggcacttgttgcgcatttattgaatgaattaactctctaagtgtgctgagatcagcaagagctgctgtggacacagaaggcttcccagagatgaaacttgaaacagaaggaatcactttacagattccaaacagtatgcacagagccaaaggggaaagacgggggatgaggatcttttgttttggagccccaggagtttaagcagaaccaatgctctgtcctgcaagcacccagcttttcttaaaatagattcaacactattccccagagctccagaggcccatgatgcaatgtaaccatctgtaattctgctgaggcacaaacccagatcctacgtgacctgaggcgtggtgtggcaagtcatggcagcatctagcccaccacccctcacgtctctactcctccctatgcataattttgcagggccgtttgtcaacacagaggcacttgggatgtgaggcagaaaaaaaaagacaactatttctttgtggaatatagacactatgtgagagagaaaaactagagtcaaagtttaaaagatgggctgggcgcagtggctcatgcctgtaatctcagcactttgggaggccaaggtaggtggatcacgaggtgggtggatcaggagttccagaccagcccagccaatatggtgaaactctatctctgctaaaaatacaaaaattagctgggcgtgttggcacgcgcctgtagtcccagctactcaggaggctggggcagaagaattgcttcttctggaggtggaggttgcagtgagccaagattgcgccactgcactccagcttgggcaacagagcaagattccgtcaaaaaaaaaaacaaaacaaacaaaaaaaacctaagtttaaaagatggctaatttgtggtggggaggatatttgggggtagagagatagggaagaccctactccaggaaattttaacctgttttagtgccagagacctgtgatcagaatgagtgttaaatgcatttgataaaatatctaggattataaaggaaatcaattgtgctgaaatactcttctatccaggggccccaggttaaggccctgccctctccttactctatccagaataagccagatagctgggcaaacatttctatagcttccaatttggggattcagacaagttctcctgacccatctcctgaaagaaattcaaagtggagtgtaggaagaaaatattggaactcccattttcccctatttatctaaaacataagaaattaagcattagaaatatttagcatctggatggtttccagcataaattatgggggaggggtatccaagaggagtggaaggctggccccactaggagctgaacatggcacctcacccactcatttttctgtgtgttttagttaactttgctagttaagtgcatctgtagatactgtactcttttttttttaagcaaaagttgtcctcacaaataagcacgtggcttaaaagaatgcctgccaaaaaattggagataatatcaataacagaaacacaaccaaataaaatggcagggccgacacctctgctcctagtaggaatccttcgtcagccacagagaggttaaaaaaaaagttcaatgtcatccaagagccagaaattatcaagaacactaaaatatggattcacagttaccattcttagagaaagcaatcttgccttaaagtgaacgttatgctttgaaaagcagagcatacagccaccaggatagcggatacgtattccaccatcacgttttaagtatctatttttgtactttaaaatgtacgtattttaacacatgtgtacactttatacataagtatacttacactggacgtacgagtccagttttttagagatggaagtacgcgatcaaaagtgatttgcctccacttatcatcactataccttacagcgaacagaaggcgtgtgcctcgagttcccggatcctcgatgtcccgcacacagcaagtgctcagtgaagggtgcccctgctcatagggtgcgcggcaggccgtcgctgaaggggcttatttcacctctgtgtgtgtcgttcccccgacagccccccgcctcccatacctgctaaggggccgcgggcgaggacttacagctccagacggccgtcaggcccctgcacgaccggctcctcccggcacagggcctcgagcaagcgaccccagtcgaagggctcccagccgcggctgcccagcgcccggagcacccccaggccgcgccgcgccccctcaggccccgcctgcagcgcctgcagcaggaggcgggcgggggcctccagctgcgcccagggcgccggctccacgccctcagccccagggagccccgcgtccggtgtcgccatgccggggcacgggtgccgcgccgccccctactctggtgtggggcctcagctcagaggctgaggggaacggaggactccagcgccgtccctgacgcggcggtggcgggccagctccagcgcctgttacaagctctcctcggcgttgggagaccggagaaacccggccgcccgaagccgcagccgttcccgcgctgtcggaaagggaaggagggaggcgcggccgggggcggagcctgaacgtgaggccggcgcgagggccggtcgcaaggggcagggccgggcacaagtccagccggagtaggtgggcggggccaaggcctggggcgtgcccatgggagggggcgtggacaaaacaagtggttagtttgtgggcggtgtcgggccagggagcctggagcggggcgggggcgggggttgatggaggggtggatccgccgctgacgaccccaaccctctccctttcttcatcactccccaaagtagtggaatggagtggatgtcaggggttctgttgtgctagaggacccgcgctgtatttacgctgacggcatgttgcttgtcatggacttcaccatagaatttgaccacaatttaccaccccacttagcttcatctcttccacaggccaaaagtgctatcatttgggtttcagtcctctccagaaatagtatttgatatacaaacatccctgagaatgacatggtcacagtaaaacctaacactattaatacggccaaagactttcttctgaacttcctcccaaagaccaagcagtaaccttgctctgggtcgtttatagggggccaggtgtggctccacttcctagggttcagtttaaggaagtccgctggagaacttggcttccagccaagggtgggatcactgcaaagcgtaggaaataagcgagaagagccccacagtgcctcctaaaccttgctttgggggctagcttgtatttcctgtcccagctctgctgccacacacagcccttcattcaggaaatgtttactgagcacctagggactggggatactgggaacaaaacaaagatcctggccctcattgtcacacaactggggagagacggaaagctaattaaacaatgtttgtgatgtgttcaaaaagaacataacaccgacacacagcacgaagtgcttttaaatagggtggtcaggcaagatgaatgtgaagatgaggttggcaagccagatagaagtctgtgagaagaccatttcagtcctccctgtggagggcgggggggctctggggcaaaagcatggctggaacggagggcacttgctggatagtaataggagttgagatcagagtgggaaccaggtcagatcttaagaggcctgaggtcacagaaaggagttgggctttcactctgaatagtatggaaagccatgggagtatcttgagcttgatctgatctccatttgagccaaaatgatttcaagggagatgtcgggaaagactagtgatatttcttagataatggctgctttgcaaatgccaaaatagcaagaaagaagtttcttccagacaccttctgtttcaggtaagcagctctaactttacaggggatgttttgggtcttcgaatgacaagctgttagaggagtgggacctgatgaatagcaggcagggccaagaatgctaaaaagcctgcaatgccctgtgcatcctcacctacagctttactctgagtggctgtggctcccacccaccaaggtctgtattctggccacctgaaagggaacagggaggaaaagttctaaacatggctcaaggaccctggtggatccccgagtccctttcacaagattcatgaggttattactattttcataatgcaaaaatgcactgtgaagttttccagaagctaagtgacaagtaatattgcaacagattgaatgcagaagcagccttattgcacttggcagtggggctgggctatgagcggaccactcttcagacaccagcaatgataacttaggtgcattttattggttttctttcagagtcattctacaaaagagcaaagttaaaaaccaaggccctggcaagagggtttgaaccttcctcattccaggagccctcccccattcctccatgtccccagctgtgtcactgctgcagttcatgggggtggagggcttgctacttttgcccccccaccaaaccctaaaagggaaagacctaccacctagaaactccttcccctcaccccaattttcctcaagttgatcctgattacagaaggccatggtaagaactgttggggtcctgcaggagttctgaaccccagaaggtcatggccagggcaccgtctgtgaagagcacattgtcctctggctcagcaccccttaggaacaatgctgggcccagcacctgggagtagagagaaaaatcagtgaaaacccatcaacttcaacactggttgcctcaggaatggaggaactcaagactcacatataaggttgggcagattgtacatagcacaaaggtgccacatctaagtaggcaccatattagcatcatagataccatccataggtttcatatttatcacaaacatttattataagccatgaccagcagcctcccctgccccatacccctgcggttaccacctcactcccagaggccagttgcactctctcaggccagggaggaccggaggtcccagccttagctgggagctggtgcaggtagatacactcagatttgaaggggcagcggccattccctcgcacgaagaaccggcatcggatctggctatgagagagaagacgacgaccatcaccttcaaaacctgttaccccaagaacaaggggcactcaaggctgacacataaggttgggcaggttgtacacagcaccaaagccccgcatctaagcggacaccactagcatcatagtgtagcttttacatttattctatcttccagcagatggcagtaaagtatcttaaggggcccctttctgtacttctcagtctctgagccagcaacagcagcggccctgggaacctcctttcatttttctggtttattttgtttgttttttgggttttttgtttgtttgtttgtttgagatggagtcttgctctgtcacccaggctggagtgcagtggtgcaatctcggctcattgcaacacccacctctggggttcaagcaattctcctgtctcagcctcccgagtagctgggactacaggtgcatgccaccacgtgcagctaattttcatatttttagtagaggtggggtttcacaaaattggccaggctggtcttgaactcctgacctcaggttatccaaccacctcagcctcccaaagtgctgggattacaggtgtgaaccactataccagacttttttttgtttttgagatggagtttcacatttgttgcccaggttggagtgcagtatcatgatctgggctcactgaaacctccatctcccaagttcaggcgattctcctgcctcagcctcccaagtagctaggattacaggcacccaccaccacgcccatctaatttttttgtatttttagtagagacgggttttcaccatgttgctcaggctggtctcaaactcctgacctcagataatccacccaccttgccctcccaaagtgctgggattacaggtgtgagccaccgtgcccggcctttttgtttttttttttttttttttttgagacagggttcttgctctgtcacccaggttggagtgcaatggcatgattacgctcactgcagccttgacctcctggggctcaggtgatcctcctgcctcagcctcttgagtagctgggactgcacgcgtgtgccatcatgcctggctaatttttatattttttgtagagatggggcttcaccatgttgcccaggctggtctcaactcctgggctcaagagttcctccccgtcagcctcccaaagtgctgggattacaggtgtgagccaccgtgcccagcccctcagtttcttcttctacagtatgaggatagtaagagtccctgcctcatgcagtttacgagatacaaagcctgtcacacaataaacctccatctacaccatctcctatcacatccagtcctgagcgctccccttgggaaacttccaactggtggcccagctgccagtacagttgctgttgaacaacacaggcttgaattgcctggggcagcttatacgcagacaagatcctggagacagcaaaaccaattccctcctcttcgtccttctactcaatgtgaagacaatgaggatcaagtcgtttatggtaatctgctttcacctaatgaatagtaaatatattttctcctttatgattttaacgtttcttttctctagctcactttattgtaagaatacatattatgttatataatacatataacatataaaatctgtattaattgactttatgttgtccgaaagggttctggtcagcggcatgttattagttaagttttgggggagtcaaaagttatacatggccaggtgtggtggctcacgcctgtcatcccagcactttgggaggctgaggcgggtggatcgtttgacctcagcagttcaagaccagcctgggaaacatggcaaaaccctgtctctacaaaaaatacaaaaattagccaggcatggtggtgcgcgcctatagtaccagctactggggaggattgcttgagccaggaggctgaggctgcagtgagccgagattgcaccactgcactccagcctgggcaacagagcgaggctctgtctcaacaacaacaacagcaacaacaacattctatatggattttcgattgcatggggttcggtgcccctaacccctaagttgttcaagggtcaactgtatttcctcacttccatctctctttgcctgggacaccctcttttttctcctcctgaggaaccctgttcttcccatgcacagcttaaatacttccccttctgtaagagtcactcgagttagtgtttccttcagtaattttgttgatgcagctattagcgttcacaggtgtctccagaacacgcctgactatctcctgggtgaagacgaggcctccttctttatccctccctttacccaaatacactttgcatagatcaagtgtagtaaaccctttgggaaggtggagttaggaacttggaattgcagctaattccagattttgaataagtgcttaccctccccaagagattcagacctatccaataaggctgcctttcagcccccttctcagccaccccatgttttcaaagagcagctaagcaaataacatgtattcatatcagtttactttcctgccttatgacaaattggaaataaaagccaaagcaaggcttctcatggtgcagagagaaccagagttgctctaagttgattctgagccaagttagaagagaaaattggccctggtgttccttctgctatctcagccactctccgtttattaagtgggctttctttccttttttttgagacagagtttcactcttgttgcccaggctggagtgcagtggcacaatctcagctcactgcaacctccacctccagggttcaagcgattctcctgtctcagcctcccgagtagctgggattacaggcgcctgcaatcacgtctggctaatttttgtatttttagtagagacggggtttcaccatgttggtcaggtggtcttgaactcctgacctcaggtgatctgcccgccttggcctcccaaagtgctgggattacaggtgtgagctaccatgcctggccttattaactgggctttctgaaatcatgaaaatagttcatgccttcacctgccattttggtcactctaaacttcagggctttggggattcactggctgggaaccatggctgaaccagaatgaatcaggggctaccttctccacttccctaaccctgagtctcgttccctctgcagcctcacctggtccgagccttgaagttcctgatgagttgctccttctgggcccccttgctcacccagaacttgtgggggatgatgtagctggaatggacacggcactgtggacacgccctgagcagtggagtagaatgtgggagaatagtcacaggcccccaggccagcctcctcactggggtgtttccctccatccctgttgggacccccatgacactgacttgatgacatccagcgggaagtcctgccggttcttccgccaggtgcgcaggcagcccagacagtgggcatgggtgcagttgggcaggatgccgaagacccgctgggcctctggcttgtcccacactttgtccatgcagatgccacacaccacatcccgactgtcctgcttcccaggcagccacaggtagggtcagacactccacccgcatgcccacattcagcctcagtggccaccaagccctcccccagcagatctgggtgtcccagagggccagaaagccatcttttgccacccctcacccacaacctgctgcacctcaaggtccaggctctgaagtggcgccatgagctctcggacaaggtggaactttggcagagactcctgggagtggccgtgatccctgtcagcagctgttgggaaaactgcatccattcactcacccctgaggcaaccactgagcatttcctgcatgcaagactctgtggtaacccacgtcctgcccccaagtggattagagaccagtcagaattagaagcctctcatataggccaggctcggtggctcatacctgtaatctcagcactttgggaggccgaggtgggtggatcacctgaggtcaggagttcaagaccagcctggccaacatggcgaaaccatctctagtaaaaatacagaaattagccaggtgtggtggcgagtgcctgtaatctcagctactcaggaggctgaggcaggagaatcgcctgaacccaggaggcggaggttgcagtgagctgagatcatgccattgcactctagcctgggcaacagagggagacttcatttcaaaaacaaaaaaaacagactgtaatcccagcactttgggaggccaaggcaggcagatcacgaggccaggagttcgagaccagcctggccaatatggtgaaaccctgtctctactaaaaattcaaaaattagccagtcgtgatggcatgtgcctatagtcccagctactcaggaggctgaggcagaagaatcgcttgaaccaggaggcggaggttgcagtgagccaagatcgtgccactgcactccagcctgggagacagaacgagactctgactcaaaaaaaaaagaagcctctcctatagccatttagaagagtgctgttcaatacagtaaccaagagccatatgcggctcttgagcaactgaaatggggcaagtctgagttgacacctgctataagtagaaaatagggccaggcgcggtagctcacgcctgtaatcccaaaactttgggaggctaaggtgggtagatcacttgagctcaggagctggagaccagcctggacaacatggcaaactctgtctctatcaaaaataaaaaataggccaggcgcagtgggtcatgcctgtaatcccagtactttgggaggccgacgcgggcggatcacgaggtcaggagatcaagaccatcctggctaacatggtgaaaccccgtttctactaaaaaaatacaaaaaaaatgagccaggtgtggtggtgggcgcctgtggtcccagctactcgggaggctgaggcaggagaatggcatgaacccagaaggcggagcttgcagtgagccgagattgtgccactgcactccagtctgggcgacagagtgagactcagtctcaaaaaaaaaaaaaaaaaaaaaagatgaagtactgatacgtgctacaacatggacgaacctagaaaacttcacactcaatgaaagcagccagacacaaaaggccacatattgtaagattccgttcatatgaaaagtccagaacagccaaaccacagagacagaatgtggattagtggatactagaggctgggagcggggaggatgaaactgactgctaatgggatgataaaaatgttctaaaattgggtagcagtgatgtttgcataactttgtgaattaacgcattgaattgtataaattgatgaattttttggtttgtgaatatttcaataaagctgttataaaaaattacatatgtgacttaaatttctttatattctgaataacattgatttagagcaataatttaaaaaatagccaggccgggcacggtggctcacgcctgtaatcccagcactttgggaggccaagtcaggcggatcacgaggtcaggagttcgagatgagcctgaccaacacagtgaaacctcgtctctattaaaaatacaaaaattagctgggcatggtggtgcatgcctgtaatctcagctactcgggaggctgaggcaggagaatcgcttgaaccctggaggcggaggttgcagtgagctgagatagcgtcactgtactctagcctgggtgacagagggagaccctgtctcaaataaataaataaataaaataaaaaatagccactaacatttagtgcatactctgtaccaggtactgtgctaagcatatcaaccctcaaaataagcctgtgagttaagtattattatcaatgccgttttgtagatgagggaaccaaggcccagagaggttaagtgacttgtccaagatcacacagctactgggtatagggatagggcatttggaactagggggttttactctgttggtaccatggtattctgcttttagaacacacaaagcaacagaactagaggaaaatttccctccagctgggaatcttgaagaggaaggggaatggatgaaaacataaaccctgctcagaggcagagcacgagctctagtgtcagtgcccacttatgcccacctgcggtgcccctgatgactcacatgatgaaggcagggacttccaggagctgccgccaacctcctcagccttgctagccagcccctccagggcaggctccatgccccagcaggccctggcccagccccagcccacagccacagagggcaggtaggtgggctcggatcccctgcgggccagtcctaggtggggccctggcagagtgacatgtggctccgaatggcggcgaccccactccagggggctgggggtctttgggtgctgacagctgtagtggggaagaagagagtgaggagacagggacagccctccggggctcagagccagctcagcctagaacttggagctgagttgggagaagcagctctgggaagatacatgatttgtgaagggacgatctctctagtgtcccaccctaacaccactccccagaggggaagaagagggacttacctgcattgatctccacgatgtccagggaagcagaagccttgctggaagtacttgcagacctgggacacctttccatcatgagcaaagcgatgccttgacccccagcgatgggcccggaaaacaaagttcctaagagattgtctaagtcatgcccagccctgttttagttcctgcctttgtgatccttacagacagaggctgtctgatacggtgagaacaacacaggctctggaattcatctggtgttcaaatcctgaccccactgggaacactaggtgagtaactcaccttctctaaagcttggtttcctcactcttaagagtggggtaacaggctggatgcggtggctcatgcccataatcccagcactatggcaggcacaggcaggcagatcacctgaggtcaggagttcaagaccagcctggccaacatattgaaacactgtctctactaaaaatacaaaaatcagccaggcatgatggcaggcaccttgggctactcaggaggctgaggcaggagaattgcttgaacctgggaggtggaggttgcagtgagccgagatcacaccactgcactctagcccagtcaacaagggtgaaactccatctcaaaataaaaaaagggggggtgggtggtaacaatgcctagcccttgctgagttgttgtaaaggtttttaagatttttcacaatcagcctggcctggtggcttacacctgtaatcccagcactttgggaggctgaggcgggcagatcacctgaggtcgggagttcgagaccagcctgaccacatggagaaagcccatctctactaaaaatacaaaattagccgggtgtggtggcacatgcctgtaatcccagctacttgggaggctgaggcaggagaatagcttgaacccaggaggcagagattgcggtgaactgagactgtgccattgcactccagcctgggcgacaagagcaaaactccatctcaaaaaaaaaaaaaaaaaagattttgcacaatgcatatagcaggtgcttggtgatcacagtgatcactattactctccccaaaagtagagttgtggattctggagtcagaattctaggttcacattctaccaccaggactggcttcaccagtggggacctatacaatcacacaggggccctacacttgcattaatactctgctgtcccggtcttgaaattattaatagtttttgagccccacattttcattttgcaatgggtcccacaaattatatagccagttctgcctagtaacactactttttggttacgtaagcttggacaagtcacctaacttttccatgcctcagttttctcattcgtaaaatggggataatagtaggacctacttcctggggtgatgtcaaacttaagaccctgtctgtaaagtccctggcccatagcaagccctgggtaaatgacagctgttgccatcacttctcttatcacttcccctctcccgccccctttccctcctcctctgaggaatcaaggtgggaggtagagaagggtgaggggaggatgaggtgggcaagcatttagtgagagtctcctcagtgtccaggcctaggccaggggtctgggacaggtacaaggtagaaaggaactcagctgttgtcatgccttaccttgccctgagggggaaggagcccacacatgaggagaccagggcagggacagggacagaggctgcattctagttccatgagagcaggctggcccagcccaagctgagggtctgccagagtgtgggtcacacctcttccccggagtgtccaaggacaaggtgctatagcagagaagcagacacagaaaaggagaggcggctgacagggcctgctcttgctagtgaagatgccagattgtcagtcacatggtccttcatttataacagtgcgtggagcccctgcatgataactctatgactccagctgagaacccagaaaccagggccaggactagggcaagtgagtgaggtactcgtcttggacatgaaattcctggggctgccaaaagaactaagtaaccaagagaaataatattttatttctctcactccaggttgcggcaagccgagattatgccattgcactccagcctaggcaacaagagcgaaattctatctcaaaaggaaaaaataattttttttttttaaaagatcaaaactaggctgggagtggtggctcacacctgtaatcccagcactttgggaggccgaggtgggcggatcacctgagattgggagtttgagaccagcctgaccaacatggagaagcccgtctctactaaaaatacaaaaaaaaatcagccaggtgtgatggtgcatgcctgtaatcccagctactcgggaggctgaggcgggagaattgcttgaacctgggaggcggagggtgtggtgagccgagatcgcgccattgcactccagcctgggcaacaagagcaaaactccatctcaaaaaaaaaaaacgatcaaaactaatgcaaaaatatccactaacgaaatatcaaacttcaggccaggcacagtggctcacacctgtaatcccagcactttgggatcgcttaagctcaggagttcaagactagcctggccaacatggtgagactctgtctatactaaaaatacaaaatattagccaggcgtggtggtgtgcacttgtggtcctagctactaggaagctgaggcgggaggatcacttgagctcaaaaggttaaggctgcagtgggctaagatggcaccactgtactccagccagggtgacagaacaagaccctgtctcaaaaaaaaaaaaaaaaaaaatcaaactcttgaataaagacaagagccaaccctgtgcaactcatctcatttcccttccccagtccaggccctacaacacaggcgtaaataaccaagactaatgcagatcatagcaggactctgacagaaacagtcaacagtgatgaagtggatggtggggtgggaggtcaggaaaggcctttgaggaggtgctagtaataatcatcactagtgggccaggtgcagtggctcacacctgtaatcccagcacttcgggaggccgaggcgggtggattatgaggtcaggagttcgagaccagcctggtcaacatggtgaaaccccgtctctactaaaaatacaaaaattagccgggcatggtggctcgcgcctgtaatcccagctactcaggaggctgaggtaggagaattgcttgaacccaggaggcagaggttgcagtgagctgagattgtgccacttcactccagtctgggtgacagagcgaaactctgcctcaaaaaaaaaaaaaaagaaagaaattgtaacttttgcaataatttatgtttatgatgaaaaccatcagataacttagagtatcaaggggagacataactttccaaatttcttttaggtggtttacaagtaaaaatgttggaatatgcctaggctggtgagttgagggaagcagacagtaagaggctgggttgaagtagggattagattagtgggcagcagccaaagttagggagggcttgaggggtgggggttcaggggtgagtggaggtgaaacagtcaccgtggaaggggtgagccctgagaggaggagcctctaatctcacaggggtggagccagtaaccctcagagcaagggacttgcaggcctcatgtcccctgtccaccaataggggatgtgctggaaacgctttgccttttcctaagggccactaatgaggctgacctcgaggactgtcagaggccatcaccctagctccttcattagcccaaaaagtccagtgacagagctctcccagcacatccagagggactctctgcccattagatgggccacagaaacagagggtaggggtcttatgattaaatcaatctgaaaaactcttcagacccggcacggtggctcatgcctgtgatcccagcactttggaggctgaggtgggtggattgcctgaggtcaggagttcgagaccagcctggccaacatagtgaaaccctgtctttactaaaaatacaacattagctgggcatggtagcatatgcctgtaatcccagctactcgggaggctgaggcaggagaatcgcttgaacccaggaggcagaagttgcggtgagccgagatcgcgccattgcactccagcctaggcaataagagcaaaactccatctcaaaaaaaaaaaaaaaaaaaaggaaaaaagaaaagaaaaactcttccttctctctcaatatatatgttttttttaggaagtaaagtacacttggaaaagggccaagcaggtggcttgagagatccaaggccaaaggcaagcaccttctataattcaggtactgttcttttttttgttttgtttttgagagagggtgcaatcttggcttactgcagcctcgacctcttggactcaagcaatcctcccgcctcagcctcccaagtagctgggactacaggcctacactaccatacctaatttttttttatatgttttgcaggcctagggtctcactatgttgcccaggctggtcttgaactcctgagctcaagtgatcctcctgcctcagcctcccagagtgctgagattacaggagtgagtcacatgcctggcctccttctgtattttcttaggggcatattatatagtgtttattgtaggtaaacatattaaaggctctgatatgtcctgcaaaggaattgatttgatttaacccaggattgcttaaacttgtcctttctgttactcgattaggccctccacagccagacacctcttagcataccaataaaacacattttgtttgggggaatgtcaaattagttcatttgatcctcaacacaagccttaaaagtcaggaatcattcttccagttttcaaacccccttagacaggaaagtaactggcctgagactccaaacaagagctaagcttatataacccaggtgtcctcactcagccaataattctcttgttaaccaagattgacttgtcaggggtgagggctgctggatttggggaatttctcaggccaagttctcaggccaaggggtagggatagagcagccagaggtgacaggtcatgcagtcctggggaggcagccaaaggggctcagaggctgggaagccaaagaaggggtggagccgtggggccctgaacagtgagcccgaggagagaggactggactccatgggtgaagggagactgtgggaaaagggagaattgagaaggggatgattggcagcaggaggggccaggtggagctgccaaataagccctctaccaggatttttacaacctgagagcccaaatttaggtgccaccctcctgtcctggctcaggaaggaacaattgaaaatctcctttaggggctgggcatggtggctcacacctgtaatcccagctgtttgggaggccgagtcgggcagatcacctgaggtcaggagttcgagaccagtctggccaacatggtgaaaccccgtctccactaaaaatacaaaaattagccagtgtagtggcacacacctgtagtcccagccactcaggaggctgaggctgaagaatcacttgaacccgggaggcgaaagctgcagtgagccgagatcgcaccactgcttgagtaacagggcaaggctccgtctcaaaaaaaaaaaaaaacaatcctttagtaaacatcctcccctacccgccaacctccccatctactacatggctgcctttctttctagcctgggaaaaccaggacacactgagaccccaagctccacaagtacccctcctttacccaaagtcagttttctttggagaactgatctcttacagctgtttgcaaaatgaatttgtgctcaggtaagaatgatggaaggcccaatgagctagcatgcccttttacaaagctggtatccccaaaggcataactctctaatggtgcaatgttcaacctggcatgtttcgtccaaacatttatgtgtacctggaaccatgctaagtgctggggctacaaaggtgaccagaagaccagatcccagccgcatggagctgtgtggtgtttctgggcaagagaaacctttgttgggtagaaaaagaaaagaaagtggggaatccctgctctagatggtcagaccctgagccaggcctgaatcagctgggcagcctcagtctgtctttccccctctctggtctcagtctcctcctgtagactatatgagggtgagacatgacctctagacccttccaactttgggcaggaggaaaggaagccgcttcttatcagatgcatcccaaattcttagaggctgggcttccagaggccaggccaaactccaaagaattttttcccacctcccctgtgtttccctgaggtccagccccctacctgcatgacctctgggagtggcggctgagctccccaccatggccactgccgtctggccctgcagggtccatcccagctgcagcccttagtaagaatctggtggggccgccctagtgctcctttatcccaccctctgggggcagggccaaagggaggaggcgatttgcagccaggcccgccccatcccatggccccaggcctgctggtgggaggcatggagggcccagccatgatggctggggagctgggggctcagggtgtccaatccaggctccagggctgtgggtggggtataaaagccctcaaggatgtttaggtaattattggaggaaattgggggatggtttaaggactttaacagtctgggaaggcagggtgacttgggagggggccacgaggacctgggagtctgggagtcctggggcttgggaagtaatgtgtcgtctgaaggtatttgtgactgaggaagccgcttgggagcctccccacacctccagagctacatgagccccacctgtggagctaaggtcaggtggagagatcagagagcaggctgggagatggtgtgagctgggtgggggcacagagaggctgatccaaactggccctgtactggacagatccaggaggctctagggtcctgactccaggcctgagatctttccacaaaaagtccctgttgcctggcctgtgtttgccaatgaaaccagcttgctaacctggtcacaaaaaattagaatagtgttgatgtcctagcaaaggccactatgaaaggtagccaggagggggctgcccgaaactgtatgtggtgaggacactccacatcggatgggaggaaggcagcccatcagagcctcctttttgggtatattgagagtagatggttcacctggcttggggctaaccctgagtgatccagagcctacgtctgtgccctccaggaggcctatggaaatgtctgtctgggagggactgaccctaagtgcatcttcccaagagttctcaatcaagttcctcaaagacatgctgtgtgcctcttccctgcaacctcctggggactgactgatggcagggctcgccggcactcctggaaatccaccggccccaagaaccaggctatccctgccccgatggcgagcctgagctgggtgatggactgattgattccctctctcagtgagtctgtcccccgcacctggtcctgagagcagcatggccgtgggatttgggccctgctggagcgttggtcggggactttctccccttctccctgggatgggggtgctgagcagcccagtggggcacaggaacattgtttctggccgaggaggctccaggcttggcagttgggctgccaggaggttctgtgagctggcactacacttcataactcccttttccagataaacaatctgttgtcttaaattgtttgcggcaaagattatctgataaagttgttgtgaagatgaaatgaggccataggtgaagattgcttggcactgggcctgacacacagctcagcgagggtttatagcggggaaagagcaacgggcggggagccaggagacctgatatgaccttggacaaggtgcctcccaggccttggcctcagtctctgctacataatgtgtctgaggagatggggaccttagagaagggggatcatggcctctaagagcgcttccagctctgtttctaagactccctgaattcccatcttacgcctccaaagcccagtctctctctgccagactgtactgccctgtgtgggagacaagatgcgaaagttaaaaaaaaaaagtaagaggaattaacttaaaattaaaggagagattttaaaattgaattttacaacttcctatgcctatcagtaggttgaaacactaggttgggaaaccaatagtcctggaaatttttgttatatatttcacttttgctggatcaaattttttttttttaatttttataggtattaccaatatgaccttcattggaggctgcgccagtttacaatcctaccaacagtatggactgcccgtttcttcacacccttgccaacacaatgttatcaaacttttaagtattcaatttagtaagtaaaacaacagtatctcagctgggtgccacagctcacacctgtaatcccaggcctttgagaggccaagatgggaggatcgtttgagcccaggggtttgagaccagtctgggcaacatagtaagaccctgtctctacaaaaaatcaagaatagtgaagtgtggtggtgcatgcctgtagtcccagctactcaggtggctgaggcagcaggatcgcttgagcctgagaggtccagtctgcagtgagctctgatcatgccattgcactcagcccgggtgacagagtaaaaccctgtctcaaacaaaaacaaaaacaaagcagtatctcattgtagttttaatttacatttctcttatgaatgaggttaagcatcttttcatatttttcttttttttttttttgagacagagtcttgcccttgttacccagcctggagcgcaatggcgtgatctcggctcactgcaacctccgtctctcccaggttcaagcgattctcctgcctcagcctcccgagtagctggaattacaggcgctcaacaccacgcccggctaattttgtatttttggtagagatggggtttctccatgttggccaggctggtctcgaactcctgacctcaggtgatttgcccgccttggcctctcaaagtgttgggattacaggcgtgaaccaccacgcccggccatcttttcatattaagaggcatttccttttatgttcatatcctttgctcatttttcaattggattgaccttttactcattgatttataactgttcttttttttttttttttttttttttttaagacggagtcttgatcttgtcacccaggctgcagtgcaatggcacgattttgcctcactgcaacctctgcctcccgggttcaagtgattctcctgcctcagcctcctgagtagctgggattacaggtgcccgccaccatgcccagctaatttttgtatttttagtagacgtggggtttcaccatgttgtccaggctggtctcgaactgctggcctcaggtgatccacctgcctcagcctcccaaagtgctgggattacaggcgtgagccaccatgcccggcctataactattctttatataataaagaaattagcccaaaggttttgccatttttacatggttggtttaaaattgcttccttatggtgtgttttatttcaggcagaacatttttaaatgtatgtagcaaaagtttttaatactttatattttgggggaacagtgtctccctctatgcccaggctggagcgcagtggtgccatcttagctcactgcagcttcaaacttctgggcttaagcgatcctcctccctcagcctcccgagtagctgggactacaggcatgtaccaccacgcccggctaatttttaaaaacgttttggccgggcatggtagctcatgcctgtaatcccagcactttgggaggctgaggtgggtgtatcacctgaggtcaggaattttgagaccagcctggctaacatagtgaaacctgtttctactaaaaataccaaaaattagctaggcgtggtggcgcacgcctataatctcttgggagattatatcaactacttgggaggctaaggcaggagaattgcttgaacctgggagatggaggttgcagtaagccgagatcatgccattgcactccagcttgggaaacaagagtgaaactccgtctcaaaaacaaaacaaaacaaaacaaaacaaaactttttggagagatgggggtctcactatgttgcccaggctggtcttgaactcctggccccaagtgatcctcctgccttggcctcccaaagtgctgagattacaggcatgagccactgcaccagcctgatgaacatttttattgtttccaaatgtttgctattgctcctgtaaacgtttatataagtcttggtgtaatttgatgggtttctctctagggtactgtctcaggatggcttctctaggaaatagatttggaagtttacttgcacaacactttctggggaatgctctttagaacaacacctgtaaggaactgaaggaagcaggattggtcagaggattctccctaaccagttaagttaaccattgaagttaagctgcaatgtaattataagagaagcctcagctctggagctgggccagtctttgcagttgtcccaaaacgggcaagaaggcttggcctttgtactcccatgttggacacaggctgccctgagcagggcgtgtgcatatccttgggtgaggcagcttcctttggtaagggcaattcactgagaggaactcagctttgaattcagcagccgatacccccagcagctgggtcctgaggggtgggatctgggtggtgcccggtagcatccacaggcacattttaataggaaaatgcagggtaacagagtgtgtgcaccttcaacttgactagattttgccaaattgtttttcaaattgatcgtacagcacaacttctcccttctgcagtgtatgagaatttttattgatattctttccatattttctacatcttgatttccctgtgttattttctggaaattttctttctttttttttttttttttaagacggagtcttgctcggtcaccaggcaggagtacagtggcatgaccttggctcactgcaacctccgcctcccgggttcaagcaattcccctgcctcagcctcccaaggggctgggactacaggcgtgcaccaccacgcctgcctaattttttgtattttagtagaaacagggtttcaccatgttggccaggatggtctcgaactcctgacctcatgaaccgcccacctcggcctctcaaagtgctgggattacagacgtgagccaccatgcccggccgaaaatttctacagatccttcttgaggagcaaaaaataatctctagctgtgtctaatttttaactcattcaggtttttttttttttcttagaagttccaggcatttcttaattttttttttcttaaaaaagcaaattggctgggcgcaatggctcacgcctgtaaccctaacactttgggaggctgaggcgggcagataacctgaggtcaggagttcaagaccagcctgaccaacatggtgaaaccccatctctactaaaaatacaaaaattagccgggcgtggtggcggccacctgtaatcccaggtacttgggaggctgaggcaggagaattgcttgaacctgggaggcagagtttgtagtgagccgagatcatgccattgcactccagcctgggctacagagcgagactacatctcaaaacaaaaaaacaaacaaagcaaattattcctttcttatgttttgattttttttttgagtcgaagtcttgctctgtcgcccacgctggagtgcagtggctcgatctcagcttaccgcaacctccatctcccaggttcaagagattctcctgtgtcagcctctggagcagctgggaccacaggcatgtgccactgcgtctggctaattttttgtgtttttagtagagacagggtttcgccaggctggcctcaaacttctgatctcaggtgatccacccgcctcaccctcccaaagtgctgggattacaggtgtgagccaccacgcccaaccttgatttctttttttttttttaatgtattttttattttatttttattttttgagacggagtctcgctctgtcgcccaggctggagtgcggtggtgcgatctcggctcactgcaagctccgcctcctgggttcactctattctcctgcctcagcctcccgaatagctgggattacaggcgcccaccaccatgcctggctaattttttgtatttttagtggagatggggtttcaccgtgttagccaggatggtctcgatcccctgacctcatgatccacccgccttggcctcccaaagtgctgggattacaggcgtgagccaccgtgcccggctatctctctaataaacttctaatttcagaatacttttaggtttatagaattattgccaagagaatcttctaagtctcctaagtttgctttcttctttttttagtttaaatgcttgattcatttgtcctgagcattattaaaaagagaccaggtgaccaactgttttccccaaagttttgatcctggctgaaaagcagagatcctaaggctgcggatggaataccggccatgcctcttcctagctgtgaccacaggcacaccccttaatctctcattgcgcttcctcctctgtaaaatgacaggtgataatgtttaccttataagattagaggtgatgtatgtataatgcatgaatagctgcttaataaggaatagcaattagggtagtaacaacgggggccagagtcatatgatgctctttgcagcaccagaagccaggcaaagtggttgagacagcttcgactctctgaactgagtgagaactggttatttagtatactgggttcttcagtgctgggaagaggactggcctttaacaactgagacacacacagtctttgactattttttccccatttgatagtgtgggaaagaatagggaggtgagtaaaataaaccaagtgtagaaagtaaaaaaggttcctcttcaaagtttcccttcttgttaaaaaataaatcataagtgttagaaataatagtttcttttaaagactaacttccttcaagccaccttgttttgtgctaataactctttgttaagccctatcctgtgtagctgttagatataagggaattagtacattctatgtccttgtactttaaccagatatttggttattacttttctaagtccttttgcaagcaacttcctcttttcctttgttctcccttgccttcacctatttaggaaagttttaagttattagccagtcaggtttagcttagattgtgtggtctggcttcagccaatggagacaggacacagtagcagggacaagctgcataaaggataaaaattgcttccctcctttgttcgtgtgtgctctcgccattgttccatctgtgaggaacacccttcctgcagaaagtaaaattgccttgctgagaaaactttttgtctaaatgctaatttttccttatagttccaaggaacaagcattctgtttctgaataaacattttacttataacaccaagtaaaccagaggattccattataaaaaaggctaccaatttcagagatgccctggttccaagcacccctttttttcttccttctcctcttttcctcctgttcccctggggctgtcactctctggactgagatgaaccatatgggacctgacaattcagattgctctgccaagatgaccagcaaagaaagaaaacaaggaggcaagtgctgtagtgaccatcccttagctgtgggcctctgggatccctcacactggggctggtgcctgtacgctgtgctagttgtttgcctgcagacgcttggttcagttcccacccttccacatgctcctctatgctgcaagggctggaagtctacaaactccatttcctagactaccatgcatttttttcccccaatgggaggtaaaagcaacagactggaagataggcagaaggaagaatcctttgcttccccaaccccaaactctgacagcacttctggcagaagcagctgagaccaggctatgagttatggggctacagcactcaagcagtgaggttccaggggcagcagtggtggtggcctcgggcactctggtggccccatatgtaccatctgcgtgaactcaggcaccagcagtctggttctacagtcaaatcaactggtgacttcaggctcctgggtcgccgcagtgtcagtgtgtgttgtagcaacggtgggccctgaataccattttcccattcagccctggaggtgagaatggcttcctgcagttagtcatctctggatgactcctatttccccctattgatctttcagtacttccaatacttttgtaacaactccctgcagtacattccccatttggaaatatttagctgtagttttttcctgactaaacacatactctgttacacaccctgacctggcctcacactgcaaacaaacccatggctgccgggggctgggctcgactggaccgctggggagatggcactcaggaaagacaggagagagctgggtggcagcaaaggagaggaaagccgtgatctcttgtggtgatgaaaaactggctttgatctattgagtcctgcatccgcctcctccaggggccttccccttccccagaccccaagtgctccaccaggtgaggccagggcaccacaagtcctttgtcccctcacaccccaaattctctctgcagggcggaaatggcatagtcgtccacctgactgacaagcggtgagcaaagcgaggtggaggcaggggagggttttggagcccaaagcctcctttgccctccagtactggatgtggaggaggcgtggagccctgtaagccccaggaaaaacatgcaagtaactgagtcagcttccagtcagctcttaaatatttaattcccatttatttaaagtttcgtcagtctgtgtacactatttatattaaaaacacaggaagctggggctcctagcaaaaatatacatttcaattttggagattgttcagacactgagaagagctgtatcctcagcaccagacccgggtcggggcagggacgcggcatgtggccggggagggggaggtgggtcccagcagctgtcccttcatagccttggcctgaaaggaagcaccccaacccccatcagctgggtaggtggggagcgggaagaatcctgccagcagagagtgatcctggggcatggaagggaggctgcagcgcccgtaggggcaggggctgggcacttccacccagagtcacacacagaatggctccttgggagggaggaccaggcaggacccaggaagcctgggcttgaaccccagttctcctacctctgtgctctgagactccagccagccccttgcccctgcaggcctggagggctctgcgccgctcagacatggcatgcccagctgtgctttggccctgctctgaggtgagcgcacctcaacctgggagcaggggagggcagggaccagcggtgtgggactggtcccacaaggtccccggacactagaggctgtgcagggagacttctaggtggccagctgggctgagtaaaggggaaggggagggcagtagagctattgggacaaatggacatcagaatgaacaggctcagtttatcccgggaagctcccactgggagcaggtgctgggctgacccaccaggacctgcaggacccctgcctccccggagacctggcccagccctgcctgctcacctgcaggcccctctctctgggttctcacctgcctcagggagggaagggaggtgcatggagcctgcaggtaaagtgatttcagtgcttatgtgtgtgtgctggaggggcagcttcagggggagtggggcctgaactcccgtggagccagctagagaaaggagcagggggatgtgaggccaggccctggccctggatgctgacacaatgtgggcggctgctactgggcaggggggcagtgggagtgctggcggaaggcctgccccgagctctccctggcctgaccccaggactcagaccccgagtcctaggggcagaattgggtgtgctgcttcctccaaccaccaatcccccctccttctcttgagacttgctcctcttcagtgaggtgggggcccacctggagggaaccctgcctacttccaagctgggagagtgccgtccagcggccagtgcagggggccatcagcaacattggcctggcaaaccagtgtgaagatggaaggacactgggtgtcagtggggctgaggtgtgctgctggagcaggatcagttgggtcagtgggtggcctcagcatcggaggggcaatgacagtcttggggaggcatctggctctcagcctggggcctcctgcccactgtcctttgcagcagggaccccatgactatagggggctgcagtcagtccaggccatgcttagccttccctggaacccaggcccagagagcttagtgtttctttggatggctcaagtcttttgctctgaagacaggagacagaagtgaggacctaagcctgcaggtgcaatgatggggcagagggcaggccccactctcttctgctcctggggaaaaggtgtgcaaaagcagaggtcctgttctatgctgctggtgaaataatacaaaacatctcacagaataagaaaggaggacagacgtggggggtggagagagaaagggagggcaagggagaagggaagagagaaacctacagaaaggaagaaacagagcaacaggaattagaaaagaaagaggaactgagaaagagggagacaacaaagacaggaagagagctggctggaggaagcgggagagagggcacagggagccagaggccgtgggtgtcatgtgtctgagggcgatcgtgggactctgctgctccaggccgggtgctcaagggctggtcaatggaaaagtcatgtgggtgggcccctccagtgctggccccattggagtctgcagggaggcctgggtgccgccgttagtacatgtccttgtagatctcctggagcagagggtgcagcgaggtctcggtttcggtcttcttgatccgctgcatcatctgggcgtgctcggtgaccagttgccgcaggtcagccatcttctgcagcagcttggggaagaggtactgggcatcagggtggttggcctgcaggtggaattcgagggcacgcaggatggtgtcctggatagcctccacccgtggaacgttcatgaggcctggccggtctgtggggacacagggcacgccagggagctcagaaaggcagtggagctcccctacttccaccccaagaggtgacttggcccaggggacggcaggcctccttggccgtgacagaccaagccctgtcccatcagcaatgctccactgggtgttctaatctccctacccctggtcttaatccacttcttttgttttttgccaatttgtccccacctcccccccgattaggcaacgtagtattgtggttaagagactcaatgcttaattcaaatcctgtgtctgcctgtgaggctataggcaggtcattcagcctctctgatgtgtaaaatggagacacaaaacattcttcctgcacagggttgttgtgaggatcaagtgagtcatcatcgatgaaaagaacagtgcctggcatgaagtaagctctagaccactgttagttagcatagttattattgtatttattgtgttggaattttaaaaatgcagaaaaaatgcagacaatttttccaccccacattaacatgacagcatactgcctgttagtccttttccttttttttgagacagggtctcactctgtcacccaggctggagtgcagtggtgggattttggctcactgcaacctccacctctcgggttcaagcgattctcctggctcagcctcccaagtagctgggattacaggcgcgtgccaccacatctggctaattttttgtatttttagtagagacggggtttcaccatgttggccaggctggtttcgaactcctgacctcaagtgatccacccgcctcggcctgccaaagtgctgggattacaggtgtgagccaccacgtctggcttagtctttttcctgtctccacctctatctacgtacataatgagatggagctgatcctgcatgctcagtcagtgccttgcatgttccactgccaagatcacagggacacttccccacactgtcagagctcaggcacagtgccctgcagtgagggccaacccccaggacgactgggtgtgccaggccagcccacctgccccactctcactcacctccacacagaatgatggccgcaatgaatagggccaggtcactgtcatcaagttccagggcgttgaacttgacagcaaattcaaacttaggctcaatgatatcactgaagggtttgcggaggctgcgcaggaactcacgggtgacaaagccactgccgttggctaccagcagcccgtccttgttgacgatagaggccagcatggcgaagatggcctcgtgcacgccatacttgagaagggtaacctggtcgttgaggaagaggctgctgaagctggggatgctcttggcgaactcagtgagctcccgcacggtctccactgtggtgcactggcagcggtagaagacgtgcacgctgatctccttgtagggaggcaggccattcaccaactgcttccacaccagccccttctctgcctgccacaatgtctcgatgtcgtggatcacaaagggctgaaaaccaggccccgttagagatcaggcctcgggagacccccaccctgtgctccccatgtcccttgcctgcaccatgaagttgagggagggagaaggcctggctctcccggagtcaggcaggcggcagtgggacccagagcccaggatgctgccaggccaagcagcagcaacactcaccgccgtgtggctggctttgccggtgaggatgctgcgggccttctttttggtcatgttgaagtttttcaggtaggcattgtagatgtgcttggagaaggccttcaggtcggccacctgtgggttgtactggctcccctcgtttgcagtcagccctgccaccagcttcctcttctcagcctccggcatccgaccaaaacggatagctgcacagggaagggggcagtcagcaaggagcccaggcaggccccagcacctctgacatccccatccctttacaggtgcatgggccaaatccttttggagcctaaggcccccagaagctctagagtcagcaaggtaggaatgatggggtggcccctccagatcgcaagctccacaagatgtgatttttttttttttttggtgtatctttgcaagagcagtgattttgtctgttttgttcacagtgcccagcacacaaggactctaacttactgagtgactgagctacgctagctggggtaagacagactttggtgacaaaggcctgggcttgagttccagctcagcagtttactagctttgtgacttggggcagactccttcacttttctttttcttttctttttttttttttgagacagagtctcgctctgtctcccaggctggagtgcagtggcacgatctcggctcactgcaacctctgcctcccgggttcaagcaattctctgtctcagcctcccgagtagctgggattataggcgcccaccaccatgcctggctaatttttgtattttttttttagtagagacagagtttcaccatcttggccaggctggtcttgaactgctgacctcaggtgatccactcgccttggcctcccaaagtgctaggattataggcatgtgccaccatgcccagcctttttctttttttgttttgagacagggtctcactctcatccaggctggagtacagtggcacaatcatggctcactgcagccttgacctcctgggctaaagtgatcctcccgcctcagccttctgagtagctgggactacaggtgcacgccaccaagcctggctaaattttttttttttttttttttttttttgtagagatgaggtctcactatgttgctcaggctggtcttaaactcctggactcaagcaatcctcctaccttggcctcccaaagtgatgggattacaggtgtgagccactgcacctggccacttttcttttttaatcagaaaaatgaggctaatactttttaaaacttactgagttattagatcaattaaataagaatcctcacatagtaagcactcaaaaattgttgtcattagtaattgagtaggatacgaattcgacttctcctggagttagcgtaaggagagggattcagtcagttccgagatttcctaagaaaggagtcaaacccagacctgccagaccccattacccaggagagccgcaaatggagggctcaggtactgctaccctctaagatgcaaggcagttagggcatccctgggtaaaagctggccaagcagctaacctgcctgtagagatcacaagaggctctcccctgtcctctaggggtcttactcagagaggtactgaggggacaggtgggctttgcaatatcctaccctggggtccgaagacaaggctctgcaggaggcctggagcacagggcagagaaggctctgtctcctgggagtgggtgacctccaagaaacttctgcctggctcctggcagttgacaaatgtggttacttactggttactgcctgccttctataaccaagaagggccacctggccttggcagtagctttcatgctgtgtcaggtcatctgagacaggcttgagtttctgggactggtgttccccaaattgttcaagctggtatcaattatcagttcccttctgggccagaatgcgtaaacctcaggtatagggaggtaaacactaccccacgcctgggacccatggtagatgctggcagtctgaggaagtggcaggtcttaggctctaagatccaaggtccagatcagcaaagccaacagccaacagccatggtgcttactgtgcgccaggcactgctctacaggtgccccctctaggctgccccaagggctccctggaccttggtttcaggctgtgtggagccagcagcccgtgagttgccctggtcagctctcaccgttgtgtgacatgcccagtgccaggcacttctggaagcggcagtactggcacttgttgcggttcttcttctgaatcttgcagctgcgctcacacttctcgtactccagcttcatgcggatcgtacgacggaagaagccctgaagcaccaagaacaggtgaggaaaggccaccaggaggtgggagggaggctgtgccaaagggcccgattatgtataaggtgtaaacactcctgacatttggaagtaacgagaagaaatttttttggaggggagatggagaaggaaagtaattctaaaactttaattaaaactattttagttcaggcacagtggctcacgcctgtaatcccagcactttgagaggccgaggtgggcggatcacctgaggtcaggagtttgagaccagcctggccaacatggtgaaaccccgtctctactaaaaatacagaaaaattagctgggtgtagtggcacacccctgtaatcccagctactcaggaggctgaggcaggggaatcgcttgaacccgggaggtggaggttgcagtcagccaagatcgcgccattacactccagcctggacaacaagagtgaaactccatctcaaaacaaaacaaaacaaaataaaacaaaacaaaacaaaaaaaaaacacaactattttaaatgtctaaagaagtcctaaagcttctttgttggggctggacacagtggctcacgcctgtaatcccagcactttgggaggccgaggtgggtggatcacctgaggtcaggagttcaagaccagcctagccaacatggtgaaaccccgtccctattaaaactacaaaaattgggtcaggcacagtggttcacacctgtaatcctagcactttgggaggccaaggcaggtggatcacctgaggtcaggagttcgagaccagcctggccaatgtggtgaaaccccatctctactaaaaatacaaaaattagccaggcatggtggcatgtacctgtaatcccagctactctggaggctcaggcaggagaatctcctgaacccgggaggtggaggttgcagttaactgagatcacgccactgcactccagcctgggcgacagatcgagattccatctcaaaaaaaaaaaaaaaaaaaaaaaaagcttctttgttagtttggtaacataagattgtctcacggctaacttgatttcttcataaatgtatctggttctgtgtatttgtgaggtggtgattcaataaaataatctgtgagattttgatgggtgtgaagttaggaaggacccacaaatatcactggaaaaacaaatgtctgtccttttttctcagagcccgctttgagccttgagaaacaagaaacccagacctcaggtaagacgatggctcagcccaagaccctcattctgccctagctgcctggtccccagggggacacaatcacccacagagctgggtcaacacaggtgcccagcagggtaggcttgacaagggaaccccctcttctcctgcagtgcccagagctgaggtctggagcacaagggcctggctgcctcctgggcaggaattctgcaataggtacagtcagggccccaccccaaggcaaggaaagctttgtggagggtcaattcaccatgtgaccacagcctcagtggccagccaccgctccccccagtccgtaccttgcacccctcacatgcatgaacaccgtagtggaagcccgatgccttgtccccgcacacccggcactccatgttgaggctgccgcatgaggccccgtcacagcccatctgcagttggtccagcagtgagggtggcgaggagctccgggagaggtctgcggacacacgatggaggggcagctccacatgctgccaggcctggaagccagggcgtgggaacagccccacagccctcgcctcagccacttaacagctgtgtggcctcagggagtcaacctttctgaggaccagtttcttcacctagaacagggggtactgacagcttctctgggaggatgggcaaaaagtctccacagcatttctcccagagcctaacatacagaagatgtccagtacacagcagctattaccatcagggctgggtcagaggcttcctgggctgaactcaccatggggtagcagtggggaggaggatggctgtgttttgggaggaaagcaagagagagaaagcagacagagggtcttagcccttaggaagcagctctcctggttcagaggttgccaccgtgtggcccatatggagatgtgtgcaacgtgttttgcagaaactgcaggactgtagacctctgcagagctagcctccccaccatcccccacaggaagttctattcttgcatagactccagggatgctgtaaacaatctcttcaagaagctcaagttcattcccatgaaaacttcttgagtagaacagcttaggtatcagtcatattgattaagcaacacactgaatttctccaagtttttctatcagacgtatagatgtttgaaccacggggtgttgagtgtgttggcgagaaaggcagtttgctaaggctatgacttcaggatatatctgctgtcagatgatttcataagaactgctaggattctcttcccagtgccctttggacactcggaaatgatctcttcatcttggaaaggggacctgaactgagtctcagcttcctgactcctagcccaaagctggtttcatggccccacataccagctgtcctacctctgccatgatgaccgtccaacctctgcactcttctctaatgactgagcaacctccccaaaagcaggtgccaaacctccaaaccagagaatcagccattttgagtagaaggggatgttgggggaccgaagccacagagataaacccaggctaatgttttccaggcctgtggtaatacctgtctactacacaggccaagcaactttgatttccccaccatgggagtacctatccacctgctaccaatcaaagtgcactccatccttcccacatggtctccccactcccccagcttccccttgggtcctaggagtggcagcaggaaagcctgcttcccctatcctgaccacaggagggggagcacaagaagcacccaactgtggcagagaggacccagtgggctgctcccctcctggctggtgaggtttaggggtaacacaagtctctggttcctaaaatggcctgtcttgtcctggcaccttagctcccaacttcagtcattccaaggtgttgtaactgttcctcttgacccagactgggacagtgggctccctacatctctcgggcctgggagggaaaagctgtgctctgggagggtgaagccgctttggtcttctcagtagcctttgtcaccgcctgacatatcctgtgtgtgttcattgttggaagccacccactagacaaaagggccacaagggcaggaactttgtccaccagggcaccagcgtggtcagacactgagagctgtgtgaggtgctgggcacgcagcaggcacgcgatagctctctgcacatctggcagtcctcaggctgcctgggtgtcctgactgcagcaccaactggctgatggggctgggcaggacctgccactcctggaggcatttataacagggacaataaaactcacagcaccggatgttggaagaaaaagagataacatgacagaaaccctttgtggatgcctgtgcagatgctggggcaggcagggtttctggcacttcctccttgaatctgtgcagtccgtgagcatatgctcgtgttggggcatttcttgtaattttgtctttgtggcctgcacgtctgcttcctctgcgagactctgcatgtctctactcacgttccctttggatctctgagctcacttccaccaccgagtcttgtccacagtggccaataccctcagattattcacacctcctggaggtgcctttctcatcctccctgtggccatggaaggtcagcaggtgtctagtcatttggtttctgttggcactgcacgtgacaatgtcaccctctgtgttcactcaaaagacacatgataagcaccttctatatgcaggacaggacctagactctatcctcaaatagctgaggtaagaaagaggtaacagcagggctgggtgtggtggctcacgcctgtaatcccagcactttgggaggccgacgcgggcggatcacgaggtcaagagattgaaaccatcctggccaacatggtgaaaccccatctctactaaaaatacaaaaattagctgggcgtggtggcacatgcctgtagtcccagctactcgggaggctaaggaaggagaatcacttgaacccgggggcaggggggcggaggctgcagtgagctgagatcgcgccattgcactcggctgagtgtggtggctcacgccagtaatcgcagtactttgggaggccaaggcaggaggattacctgaggccaggagcaacatagtgagaccctgtctctataaaaagtaaaaaaaaaaaaatagttgggtgtcgtggcacctgcctatagtgccagctactgaggaggctgaggcaggaaaatccttgagcctaggagagctgtgattgtgccatcgtataccagcctgggtgataaagcaagactgtctctacttaaaaaaaacaaaaggccaggtgcagtggctcacacctgtgatcccaacactttgggaggctgaggcgggaggatcacttgagcccaggagtttgagaccagcctgggcaacatagtgagaccctgtctctatctctataaaaaattttaaaaactagctgggtgtggtggcacatgcctgtagtcccagatacttgggaggctgaggtgggaggattgcctgaatgtgggaagatgacttgagcctgggaggtccaggttgcagtgagctgtgattgcaccactgtactccagcctgtggtgacagaacaagaccttgtctcaaaaaaataaataaacaaataaataaacaagaaaaacaaggaaaggtaaggtgtaacttaacctactgtaactcacttgtgcctacaggaaaaaaataaaatagaaaaaaaaagagaaagagataagaaaactagaacatgagacagagtggagcaacgccaggtaaggggcagtaagaagtgcaggatattggaaggagccatcactcacgcatgtgactgtcacggaaggggactgcttccctctctgctgaaagaaaggtgatggcagaattcttctcatactaggggctgggttctgaaggttccaccacttcccccgcatcatgatgtcctgggtagaggtgggggtaagcaggtgtcctgctaaaggcactccattggacacccatttcatctcacgtaaaacctcaaaacaacctttcaagatggtcttcttacccccactttacaggcaaggaagccgaggctccaaggctcagaagtgttagtaacttgctggcagcggctatgttggtcttacatatcaacttgattaggccacggtgcccagttgtttgaccaaacaatgtgctaagaaggtgttttttttttttttttttttttttttttttttttttgagatgaagtctcgcttttgttccccaggctggagtgcaatggcgcgatctcagctcactgcaacttctgcctcccgggttcaagcgattctcctgcctcagccccccgagtagctgggattacaggcgcccagctagttttttttggtatttttagtagagatggggtttcaccatgttggctgggctggtcttgaattcctgacctcaggtgatccacccaccttggcctcccaaagtgctgggattacaggcatgagccactgtgcccggccactaagaagatattttttagatgcaattaacatttaaatcagaagactttgagtaaagcagattaccctccataatgtgagtggccctcatccaacaactgaaggccttaagaaaaaagactgagtgcctaccgtggccccactgtggaacaggaaattctgcctccaggctgcctttggacttgagctgcaacatcaacttccccggctctccagcctgcctgcctttcaaaatttggacttgccactccaacaactgtgtgaaccaattcgttaaaacacatctctttctttcaacacacacacacacacacacacacaggttctccttctctggagaaccctgactaatacagtgacagagcaagaattataacctagaaccatgcaattcctggagctgagctcttaacctcggcatctcactactacgcatacctacatgttcagtaccgctaatcaataacattattatgatgaacaagaagacacagtcactgctgaggaggcaccatgtcattatccaaatgtttggattcagtgtaaacactagccctctcacccagagagtaaagtatcagtttcaccatctttgatgacaagttcagcaaatagacactattgaccttattcacatcatttgtggctgagagctctcctgcatatctagcctccaatgctgggagaatgccgttgtcatggctgtgaagacagccaggaggcgcccgattggtctatttactttgctggcagagctcacaggcaaacaagcacccagcagcttctgaagtcaggccaaattctgcagggatttgaggctgggttactgagcagcctctttacttctgctgtcctgtttgcctgaactgtgggctccttgggacaggcactcagccttgtccaccactgtatggccagccctgggcacagtgctgggcccagcctgatgcccaccaagtgcttgccaagtgaggaggtgctgaggccaggaggaaggacactttatcttcctctttctcaagggtgattgggatggatgtcactgaagcaggagggatgagaatgggaatgggaggtgaatcctggctctagctgtctctactcctacacgcccaggggaccctggcaagtgggtttctggtaacctcagtttccttgttgatgggaaggtctgtcctgcctggctggggggagggtgagaaggtgcatggcaggtgttgagctcaatatctgcactgagagtcagtgctgaactgctgaggagggtggtcaggggtgactgtggagccttcctgctgtttcagggctcaaagctgtgcgctgtccttatgggtccctcaggggactcccgaggccaaagtaataactcatggggatggggcagagaactagcaggtgctgagacctgcgatgtgtcacatacccccactgactctcacctggctggccctcaggctgggtaggacacagcctataaaggtgaagagaatgagacttggagaagtgatggcactggcgagggctacagctcacagtgacagacctgggatgcctgccctggtctctgtgatctccaagcccttctgctctggacacatgatcaggctctgtctccagggcccctcacctgccagatcctcaccccccttttaaacagttaattttacccttaaaaaaagtacagttgcctttcaaattatggaagtagtgcagacttgttgagaaaaacacagaagggtatgcaggatcttatgacacagcctccttaaccatgatcctgctcctcagagttagcccctgagtccttcggtatagactcttccggtgccttctatgaaacataaggattttaaacaatgggatccccaacttgtcaggaacttatttaatatatatataaaccagccttatccttttcaatgactccagagtattccaccatatggctctaccacagtttacataaccagttccccacagatgggcacgttcctatttttgctcttatgagcagtcctgcagtaaataagctggcatgggaatctctgagcatgctgagcaagtacttacacaggacacgttcctagaagtgggaatgcagggtaaaagaaatgcacacttggccaggtgtggtggctcacacctgaaatcccaacactttgggaggccgaggcgggaggatcacctgaggagttcgtgactagcctggccaacacagtggaaccccatctctactaaaaatacaaaaattagccaggcacggtggtgcacgcctgtaattccagctacttgggaggctgaggcaggagaatcgcttgagcccgggaggcagaggtttcagtgagttgagatcgtgtgccactgcactccagcctgagcgacagagccaggctctgtctcaaaaaaaaaaaaaaagaatcacacattaagaagtgttggcccacactaccctttcacccctggtggtgggaggaccaagtcctccccacccatctgacaggtgaaatggcattgcaacttaaggtgctttctttgagttggttagactgaaaaacctgtcgggatttcaggccattcgtatttgtcttactgttacctgttctgattttcctgctaggttgcttgtcttgtagaatttttgggaacttttcatacactacagctttaacacaaagtgattatgtcaagtaaccctctctcctgtttcaatgactgaacaaggaagtctatctccacttcatccacttattgataaacagaatctattaaacaccaccgcctacatagtaccatgtgactggtgaggcaacctctgccctggacgtttcccgctgtgccctaaatcccacaacgaagctgcctgagaggtcaccgccatgcctgcctcaccctacccctgctcccaggcacctcacctggcctgcacgggaacagtgatgctatttgggaaacagccctggtcccaagaaggggtgtggaggaaactccaggacagaacactgctctgcaggggacttccatctgcctgggctcagatgtggggatgaggtgggccacggcaggcggcatagccacaaaccctgtggccgtctcttctccttgcattctcccctgaatcctcatgacatcccacactcattcttagtccccactgtcttccctttgctttctaaccctccctaccttcttcagatttagaacagtatgtgctactggcactgagtgaattatcactcctggttagctgttcctctcttctgagacaggctgtgtctccaaagccatcccagttaccagccaatagacaggaagttgcttactcggggaatggcggacaccttcactttggccctagaatcacatttggcctactttggtcactcccaggtgatcctgggtgagatgagaaggactgaatgatggctctatactccctccacccaactctatacactgaagaggaagaacttctgcaaaattctgggacttgctttgcaggttcaaggtggtgtggctccaggattcagacccatcttagctgcagacccaaacaggagcctgcgctacctccacagccttcaccctgccttagcttggacactaactgcctcctcctgctccatgcagtcacaggggtccagagcccatttctgcggggtgggcttgctcctctgcctgagtcaccgcctgtggctaggatctcctgcagctgaaagcagcagcgagtgcagggtgtctactcccagcagtatatccttatgaccctgagttccctctaaggggaggagcgaggatgagctgcatgtgcaggcctgcagcacttgggtaaggagagaagtggtgggagaaagcaagaagcagagggatcaggccaggcgcggtggctcctgcttgtaatcccagcactttgggaggctgaggtgggtggattgcttgagcccagcggttcgagaccagcctggccaacatggtgaaaccccatctttactaaaaaaatacaaaaattagccgggcgtggtggtgcacgcctataatcccagctactcgggaggctgaggcaggagaatcacttgaacccaggaggcagaggttgcagtgagctgagactgtgccactgcactctagtctgggcaacagaaggagactttgtctcaaaaaccacaaaaacaaaaaagcagggggaactgcagcagggaaagccaggggctgcatggattctgggtgcttttgaaggtaaacataacatgatgatgatgaagatgacagaacagtacagggtactagagaaaactgtctgcactgctgataaataaaggggaaccaataagtgagacaggagaagctacaactgcttggctgcataaaaataatattagttgagttattcatactaactgcttagcatttttatctaattatgatacggctcaatgatgatgtgtataattattaccagaccaattgaactgtgtgtttcgactgatcataacaatcccaggtacagctgatctttctagtgtgctgttagtggagattggtctcagatgccttgtgttaacagtggtgggaatactaataatgatgatgacatgtgttacagatgcccactcatttaattctcacgaaagcccatatccacatcacctaccatcctttggcctgttttacagaaggaagtggtgcagcttgctccaggccccactgctggtgagtggcagagcagatccccaccgcactgggcgtgaacccaggcttccggctccagtccttcagcactctgctactctgcgccccacatgatggcgtttgcagagggccaggatccccactgcactgggctgtgcctcctctgccccgtgtcccctgccagtcctctcctcacctgtgtagctgctggaaggaagtgcatgctgtggtcccccattgagctctggggctccttctgcctctgccacttcctctttctcctcctcttcccggacctcaggggcttcctcctgtggctgctccatggctgatctcccctcggcgccacacctgcaggcccagtcatagctctggcatcgtctgggtctgaacgcagatggacctctacagggtggttcccatcagcctgggcagaggagaagacaggaagaggtcaggggaggcagtgacaaggaagaggatggtgcgagtggggcacgcttgggggctgctgtcatggagggggttcttctgctcctgctccttccctagttcctgcagtgctataccatggtctctgctccttgtatcacaagtcacctgccctatcacccttcccacctggctcttgtagtgggtttgtggggttcggagcaggctccataaactagagaggtgacacatcactgtgccacccttccctgcctcctctgctgccttctgttctgagtctccaggaagcacattggaatgacttgaggggcttttcccaactctccagcccacctggagatccagatatgcatcacgcctcccatccccgaccctgtccctatcagcactcaggcccaagaatcacggctctgctgtgctactgttcctgaaggggtgagtcccatcctttcagtggttgggtgtggaaaaaagacataaagccctgctgttcttggctcatgttgacagcagatctgcaaccatggcctcaatagcagagacatcagaaaaaggaagatgtgctccatcctggagtctttccaaggtgacaacttactgggtggtgatgccacgtccacatcacccaggaggagacagttccaacccttagcaagtaaaacattatccacaaatgccacagtcagagatgataagatcatgaggtactgtggagagtctcccagcggggaaatgtctgcaccagaccttgtggaaggatcaggagaagaaaagatctgctttaagatgttaagcatctgtgggaccccaactctcagatattttaccgacagctcaaactcaatctatccaaacagaacccatcattttccccaaacccattcgtcctctagtaatctttactttagcaacccacctgcctgtctacccactcatcagaaccagaacctggagtgatcagagactccttctgctctctctccctgctctagacctgccaactcggctgtacactgtagtcactggggagtttttaaaaagacagatgcctggtcccatccccagagattctcctttgattggtttggggagcagcttggacattgggtttcttattttttaattgtcctggtgattgtaatgtacagccaagtttgtacaaaacatgttaaggctacacattcatttccaccaggccttcccttgcttggacttaacaataacctcggggcctacttgagggtggaggctgggaggaggagaggagcagaaaaaataactatcgggtactagtcttagtacctgggtgatgaaataatctgtataataaacgcctgtgacacaagttcacccacataacaaacctgcatctgtaccctgaacctaaaataaaacaccaccacaaaactcttagctgttttctgatgggtttttttgttgttgttgttattgttttttgagacagtctcactctgtcgcctaggctggagtgcagtggcgcaatcatggctcactgcagcctttatctcccgtgctcaagggatcctcccacctcagccacccaagtagctgggaccacaggtgtgcactaccacaccagctaatttctgtatttttttttagggataaggttttgctatgttgccccggctggttttggactcctgggctcaagcaatctgcccaccttggcctaccaaggtattggaattacaggcatgagccactgtgcctggcttaaaaataatttaaattataataaaataagaaggcaaaacttaataatgtggaagatgagagggagtgatcaacattcaatcagctcaagtccctttacttctcaaaagatgtctcaagatgccgatgtatgatttccaaatcattagagtgggaaaacctggaaaaggtcacgtaaacctctagctttgtgactgaggaagcctcacagacaggagcagaccacagagacacaactaaatgaatgtgggatcctggaccagatccccgaagcagaaagggggcagtggcagaaaaactggtaaggtctgaacaacacactgactttggttaatagtattgtaccagtgttcctttatgtaagatttaatgtgagctgggtaaaggatatgtggggactctgtacaatctctgcaacttactctgtaacaccgaacttttttcaaaatagagttagaacgaaaaaacctttaaaaattttggttttctggcttctcttgaaaattgggcagacctggcccttgggcacctgcatgcctctggcacccacccccagagccaagcaatcggctgcccactcgcatggtctccactagtggcagtttctcccctgcaggctctttactcatttacactgcattgcagggacttgatagtttgtttaatgtacatcagttcctcaaggatcagtccctgaccactcgcccctgggtgttaaacttgagaagcaccagacccagagcacaggaaatgttcacaggtgctgtcctgctcaccccgtggctttctccaagtggcagctggggcagtcactcctacttctccccagctccattctccttccttctgagtctcagtcttctctggatcagcaatctgtgcctacctaaacactcaatttccccaagctctcttgcagctacagtgttcattggcataattctgaccagcaatatgtgaacagaaatctaccaggaggagcttccgaaaaagctattatttcctaatagagagacaaacttctgcccctcccatcttcctgcctggaacaggaatactatgcctagaggtgtagcagctgccttcggagcagcagaagacagggtaggagggtgggtgaaaagtccgaaagcacctggccactgtggcctcccaaagctgctggacccaccctgcaatgccggcctccagactgcttgttaggtgaaaaaatcaaacttgttttaccaggcactgattgccggatttctgttgcatgcaactgaacgcaatcctaatttaaaataggagacataaagacacttagctcaagagtagagtggggttctggggtggaagttggccacaatactggaaaaaggaccctagcaattaccaacagcagtgtgtgactgtagtggcattagtcagctttttttttttttaattgtgtgaaagacaattattcttttatttttataatatattcagactcggcatggagaggaaactaattttagctgaaatcttttttttcaaagtttattttattttattttatttatttatttattttattattattatactttaagttttagggtacatgtgcacaatgtgcaggttagttacctatatatacatgtgcgatgctggtgtgctgcacccattaactcgtcatttagcattaggtgccattatccaaataacaagtaccagaaacactgattctttatgctccaccagattgaaagcctggagatggaggaggtaggggagggtgagaaggggccacgggaggcctcagaagggatgagtcccaagagaaggagcagcacgggtgacaagggtcagatggtgggacccccgagagccacagcgcagtggcggcagagcccagggtgagtgggatgaggcaatgagaacacactctgtttttggacccatgtggcgtgggtgtcagtggacacggggcaatgcacaccaggctgtggtgatgagagccaggaagaggaggacgtgaagatgtggggtccccgcttagcaggcagtaacagaggaggaaaagctacaatactgcctggtatatatacttgacaacacagcatctgagcctctggtgaccctggggaagacctgatggagctccctgtcaggaccaaatcctggagggaggggagggagctgactgagctcccactatgcgtcacgctcccactcaagcctcgccagcccccattaaggccttataggccccccttgcagatgacaaaagtgacaggcctgaggatcccaacagggcatctcagaacatgctagaggacgaagcagaaaacggcagagcttcggacacagcaggactcgagccgggccaggccctgacagctgtgtgcactgggccgtgttactcagcagagcctcagctcccactcccacatatgagctggtagtgggtttttttcaccagaaccggtaaaactgttctcagtttcgggaggtgtaagtaagtggttgcctcttagactcagatgcagttctggactctggctagagttctgaatttgggaccagggtctctagttcccacgctgacatctctccctagcctggaattgtctcttctgactgtggcctctcaaggacaccagtgaagaggaaggggagctgtagcctggctgttctaaaacctacccacgtcccttgggctgctcctatttagattgaactgctgtgctgcagcccatccctgcattttgccagaagcctgccattttcatatggcctccttgctccatctacagctgaggtctgtcatctaccctgagccaaggttgctccctgttctcagcttgcccagccaggagcaaccttgacccctaggctctctcccctgacccactggacctaggcccactgtctagattttctcaggtagctgccaccccacccaccacaattcctgcaatgaaccctattctcctcttcctttcttaagccctggcactaaagatagcacaggctgggctgggcatggctcatgcctgtaatcccagcactttgagaggctgaggcaggcagatcacatgaggctaggagttcgagaccagcctgggcaacatggcaaaaccctgtctctactaaaaacacaaaaatcagataggtgcggtggtgcacatttgtaatcccagctactcggaggctgaggcacgagaatcacttgaacccggaggggagaggtttcagtgagccaagatcgcactgctgcactccagcctgaggacagattgagaccctgtctcaaaaacaaaaaaaaaagtccaggtgcggtggttcatgcctgtaatcccagcactttgggaggccaaggtgggtggatcacttgaggtcaggtgttcgagaccagcctggccaacatggtgaaaccccatctctactaaaaatacaaaaattagccaggcatggtggcgcacgcctgtaatcccagctacgtgggtggctgaggcacgagaatcgcctgaacctgggagacagaggttgcagtgggccgagatcgcaccactgcactccagcctgggtgacagaggagactctgtctcaaaacaacaacaacaaccacaatacagccaggcactaagtttaatttgtatgccggcaaaaaaccctggctttttttttttttggtctggctcccagtgttggctatctcccctctccacgccccagcactatgccagagccagaagccctctgatcatgtcacagctttgccccacttaagaggctggagcttcagacccccagacaacacaagggccctgagccagaatgagggggcacgaatgcagcaatgtagcccctcaccaaaaagtagtccctagcaaaataatttcttgcatggggcatgggggaagggcaagggggctcacacctataatcccagcactttgggaggctgaggcaggcagatcacctgaggtcaggagttcaagactaccctggccaacatggcaaaacccctggttatccgggtgtggtggcacgcacctgtaatcccagctacctgggaggctgaggcaagagaatcgcttgaactagggagacagaggttgcagtgagccaaaatcacaccactgcactctagcctggcaacagagcaagactccatctcaaaaaataaaaataaaaggatttcttgcaaaacaaacccctggactattccaattctgacatatatgtatgtgtgtacacacacacacacacacacacacacacacacacacacacacacacaaagcctgcagtgcacatgcagcccccatgctcccattccaatacccactgtctggccccaagaagaaactcagcccttcagagaacttaggtgcagggaggggcatgactccatccattgcccattggcaggtgaatttcatgggcagtggtagttagaagcttaacccaaatggcccagagctctagagagacctggtctggggccagagcaactaagccacctggggcccagtccttcccaccaagtccagttgtctcccttccccgtctctgctaggagtagggaggggctcactttcagggcagccctctgtgctcctggtcagctgggcaacccccaagtgcctcgtactcctcgtggtgactcaggtgtttccctgatgcccactggcaggctgtacggtgtgggaacacttctgccctacccaggggatgagtggggacagtcagtgtgccaggggcctccatcctccatgggctccatctgccacatggtacagcctgatggaccttcttactgtaccagagcctaagctggatcaccacctccatcacaatagtactagcttcccttctccaaggacttattacacaccatgctctgtgtatgttggcaaatgtaatcctcacaacaaccctaagaggcaggtactattatcatctccatttaactgacgtggaaattatggcacagagaggcaaagtaattggctcaaggtcacacagtaactagagaagcaggatttgagtcaaggcaggttggctcaagtcttagccactctactgtgtgcctcatatatggtgctgggtaagactggaccaggagctggcatgtccttgcccagctggggctccttagtctcagtctggagccatcacctctgaatcctctgtctggctgccagtccccagctgtttctgtcaagaacaccttggtcaaagcccttctggacattactgccagaaaatgactcctgtgtgctgaagacagccacaggctctcgtccctgcctccctctccaggcctatcctcctgctctgcctgcctatgtgcctcatgatcccacatcactccctgagcatggaggcttgaactggcacctgccttgaatgccatcccctccactagctaaaaccttctctccttcgcgacctgtctgcacctcctcttccgggaagctctcctggactagctccattctgttccttctcaccacaaccctgacccgggccctccagatctgcaatcactacaccaaactgcaatgtctgctaactgctctggcctcaccatgttatcagtttcccagagaatgccctgtatcttactgaggtaggtcccagcacctggcacggtgcctggcatttagtgggtcctcaacatacgtttgctggatgaataaatatactaaaaacatgagccttagccacactattctgagttgtagcacttgccactgtatcagttttcatatattactgccatcgagatgcaatactccaaagaagtgaattccaccggcttcagtcaggcctgggttcacaccctggctcatccctcccatcctatgacttggggaagacattaaaactggaatactaccacctaacctgagaggctgctgtgtggaataaataacgatgcagtaactgcttaacagtgccaggtagatagtaagggtcctacaaataaggaccacagtggctgctgctattattatcacccatggcttgtgttaagggattgtatggtgatattccagtcctagaaatgtgctagcctgctgaaacccaagggacctccacagacagaacttcccagttccctgcctcaccatcaattgtggggagagaaccggcagggagccccctactctgggcacatgcttcttttttcagggagaagggcctaaaccttcctccccttctcgccccacatgcaggtgacccagttgctgtcacctccttcctcccatactgcaacggaataaggggcagcctctggatacaagacagaggttgccccgtctccgtggcaggtgcttttgggatcagaagtgagggatgtcatgggagaatgggtctggctgattctctcccaacctttcttatcaatcattaatccaagtgctgacctagtgacctggttttctaggccagcaactctgccgtgttctctgcttactatttgccaatccaggtcaccccaccctcttaaggacacaggagaagcccgggtggccttctagctggccagagtcagcccagagagtcacctgaggccaatccccaggagtggcctggggctggttttgttcagagagtgctggaaccagagaaaagacagccaggaggccacccacgcattccacaattcttcccattgccccaagaggcagccccctaggaacagcctccagggctggagaatgtcctggagaagagaccagagacaggagggtactcttcaccagggataggaaagctgccacagaagggggccttgggtgtgcccacccacccacctgcagtagggagaaaggggcacccagatccctgcatcacctctccactgggagcactaacgtgctgaccacctctgaccgcagccactgaagactgcgaaaaatctgtggttttcacaaagagaagctcagcaatgtcaaagcacatacacatgcataaaaacaaaactgaaaagacatggccacaaatgttaagggtacttttctctgaggggtggagctgtaggtgatttcgattttcttaattatattttcctatgttatccaatttcttcacagtgagcgtgggatacctttataatctggggttggtcgggggaagggggagacatttttaaaaccaaataaaatgctgagagatgccaacgaggtaaaggaaaggcctgctcaggtcccagaagagacccagatctctcctactgaagcctgaatgggcctgagacccctcacactacatggagagggcttccagggtagggtggttctgccggccagcagagagactcaccagagaccgagccagagcccttctcagctaagaccacaggggctatggttgtggacactgtccctgcccctctgcccttctggtccctgccagctggtttcattcacttgttcaacaaatatttgtcaagtacctaccaccatgtgccaggctacattagccagcaatgaccagggctatgaaggacaaatgccaagcaaggtgtggcactcagagcacatgagtcaggtgcgagtggccaggagacgctttcctgaggaccttacgtagcctctggcccaggcaggctgagtgggattccagggtgatgggaacagtgatgtgaaaaggcccaaggaatgaggacctgggctgtctgtgggtagagagaagggctgtggctagaggtcactcagcgtcttgaagggtaagctgaggatgtgggtatttattctgggaggagcagagagccaagggggttatgaagaggatggggaggaacagagctgcatttttacaaagacttttcaggctgctgtggagaacagactgaagatgagaacagactgaaggtgataacagactgaagatgatttcagccaggctcggaggagcaatagttacagcaaacctggcaagggagtcggcaggaggggaaggccacctggagccctgcaaggtctgggaagcagctgcctgttgtgttcctgggaagactcaggctgaggagttgagggatggggccctgactcagagctgagtacctctctggctgccccacctgtgtcctcactgagtaaaatgtcagaattagatcatctccaaggcctgttcctgctctgccctcccagggttcagcctcccagaggtcctggtctcagtgattcccgactatgacacacacatacaaacacaggtatctggggagcagacgtggcgcttggcactgcttggcatgaggccaatcgatactaacagccacattcccaggcttgacaactacacccaagcccctcacacatctgacacagagctcttgtgaccaggatgccaaccataggtcaacagccctgctttaggggctctgtggttacaatgtggacaccaccacttatacctttttcttttctttttttttttttaagacaagatctccctgtcacccaggctagagtgcagtggcacaatcacagctcactgcagcctcgatttcctaggatcaggtgattctcccacttcagcctcctgagtagctgggaccacaggtgtgcaccaccacgcctggcaaatttttgtattttttgtagagacggggttttgccatgttgcccaggctggtctcgaactcctgggctcaggttatccacccgcctcagcctcccaaagtgctgagattacaggtgtgagccaccatgcccagctacctatttctttacaaacaattaagactaggacagccctttaagggcacctggctagctcagttggtagagcatgagactcttaagttcctgaagtgctttcaggtacatcacacatcacttaatcgacccagtgagatgagtgaaggcagggctatttcatttatcactacaccccctactctgagggaagctctgactggctcttgctcgcctgtgaatgctctaggtgaggggacgaaggctggtggtaaggagaagggcagccactgagtgggtggccagcaggccccatgagaggcaatgaaactctgactggcccaggagaaatgggacgtgcaattgcagcggggaggcaggaatagggatctgcagggcagagagacttctcaaccttcccagggagagaggagacatggaaaaatcccacagttaagctgtgattggtcggtctgtccaggagaacccagggatctcaagttcaagtctcacctaaaagcgttcacgttctttgaccctatacttccccttataggaaaacactgagctgttcactgcaatgttatttataataacaaaaaatcagaaatggcccaatgcccaataatagaggaatggttaaatatattagggcacacccagacaactgagtattacctagtcattaaactcatgttttcatagaatatttaataacataagtgaaaaatacaatacgaatttacataaagatcatgattctcatgaaaatgactagaaaaagaatagaagaaagttcccctgtatgaagagggtggtaggtgatttttttgagacagagtcttgctctgtcactaggctggggtgcaggtgtgacctcagttcactgaaccacctcctaggctcaagtgatcctcctacttcagcctccagagtagctgggactacagattcatgccaccacacccaactaatttttgtatttttagtagagatgggttttcaccatgttggccaggctggtcttgaactgaactcctcccggatcacaagtgatcctcccgccttggcatctcaaagtgttggaattacaggcatgagccactgcacccagcctttgttttttttttttttttttttgagacagagtctcactttgtcgtccaggctggagtatagtggcacgatctcagctcagtgcaaactctgcctccccggttcaagtgattctcctgtctcagcctccagagtagctgggattacaggcacctgccaccacacccagctaatttttgtatttttagtagagatggagtttcaccacgttggccaggctagtcttgaacccacctcaagttatccgcctacctcggcctcccaaagtgctgggattacaggcatgagccactacgcccggccttttttttgggggacagggtctcactgttgcccaggctggagtgcaatggctcgatctcagctcactgcaacttctgcctcctggattcaagcaattctcccacctcagactcccatagctgggactacagacatgcgtcaccacgcccggctaatttttatattttttggtagagtcagggtttcaccatgtgggccaggctgatcttgaactcataacctcaagtgatccacccaccttggcctcccaaagtgctgggattacagacataagccaccgcgcctggccaatgtcactgtactttgaaactttcggtaacacttatgatctttattttacttgacccacgatagcatgtgatagtgatatgactgctcgatccctcctcctctacgccttctcttcatttggcttcctcccaggttttgctctgatatcactggctgctccgtatcaatctactttgttggtctcagtcagtaattttcttcctaatctctaaaggtctctttcattctccatctacgctccatctctttctgatcttatgccagcttgtgccttccaatgccttcagtatgctgatgattccccaatttatttctccaggccagcttctctgacacctccacacggatgtccaatggcagcacaagcctaacacatccaaaaccgagccctttaccttccccccatggtctctctcatctcagtaaatgacaactccaacctttaagttagagtcaaggaatcttgctggctttgcctttaataaatatacggaatctaattacttctcaccacctctactgctatgaccctggtcccagccaacaccatctcctgcctggattacttaacagcctcctaactggctttctggcttctgcctcccacctcaccacccactctctgtacagcagtcaaagtgatccttctaaaatacaattcagattctgtccctcctgtgatcaaatccttcctggagcttcctatcacagagaaaaagcccatcttaatacctgccagcaagtccttctggaactggtacccctgcctgctccactccttctggtatattaagtaccaggcacacggcctcctgctggtctcgacacagcaggcatatcctgccttcagtgggcctttgcagcggcttttctctctagctaaagttcttccccctccccagttacccacctccacagctcactgcctcaccttcttcaggtcctttctcaaatgtggccatctcagtgaggtcttccctggcttccctatttcaaatatgcgtagtccaccctcaggtacttccatctcccttccctgcttcaactttctccatccgtcttatggctatctggcagagtgtatatatatttccttatttgtttagtgcttgtctcttcccaaagaatataagccccaggaggcagagatttttgtctgttgttagattcacataaccctcaagtatcagaggagcaactggcataattgcaaaaagacgtctgttcaccacgcaccttgaagcagtcctgtagagatcactgctccacgggcttcagttttccaggggtatctgaccctgctttccagaccactccagaccattccagacccttcaaaggaggagcttatcaagatgagcataaattggtagaaatgtggtggagagcgaatctagaagcctgaggggcctagcagcgtctggctagttcttttgctaatctgccaagtgacgttggggttggtggttctgtggtggtggtggttgcgggagggggggcttcatttttcccatggggaggcagcactggtgcttcttcctcccttaaactatacaatcctcttgctgagcagatcccaaggctactattactcagtggagggaggcctccctgactcagagtcctaggtcagacccagggtgggggtggggaggtgctgacaaatcctcaggtgcctttaaaacgtttatattttcagggcgaaagataagaccagtcagtacctgcacctactcacaggacaggctgtgcacgagggaagagtgaagggcagctgagtcctgaggaggaaattgcctctggaggcctcagggaaggttcaaggtcaaggagagctgggtcttcaagataatctgaaaagtacactatgctaattatagaaaatactgctgggcacagcagctgggcagggaggttgagatgggaggattgcttgagcccaggagttccagaccaccctgggcaacacagaaagaccctgtctcatttttttctttattgagacagagtctcactctgttgcccaggttggagtgcagtggtgcaatctcggctcactgcaacctctgcctcctgggttaaagcgattctcctgcctcagtctcctgagtagctgggactacaggcgcatgctaccacgcccagctaattttttgtatttttagtaaagacgggatttcaccacgttaaccaggatggtctctgtctcctgacctcatgatctgcccgcctcggcctcccaaagtgctgggattataggcatgagccaccacgcctggcctttttttttttttttaataaaaacaatttaaagaagaagaaatagggctaggcgcggtggctcacgcctgtaatcccagcactttgggaggccgaggtgtgtggatcacgaggtcaggagatcgagaccatcctggctaacacggtgacaccctgtctctactaaaaatacaaaaaattggccaggcgtggtggcgggcgcctatagtcccagctactcgggaggctgaggcaggagaatggcgtgaacctgggaggtggagcttgcagtaagccaagatcgtgccactgcactccagcctgggcgacagagcgagactctgtctaaaaaaaaaaagaagaagaagaagaaataaaatacttaagagtttcaaagaagaaaataaagattgaggggtagggtgtcctaggtaggggaaatgtaggatcctagacccaggagaggaagatggagaaagaaagaaggagacagggaggcagggaatggaaaaggctgggtaagcaggtcataccaaatgcatgcagaagaccttctacaactcttcttccatggagcctacccagcttccgtgtgaatcaaacagtgcacagcacctctgtgtgccaggcattattctaagctgctttcatggagtaactcccttaggttttacaagtggactataaggcaggtacccattatccccatttacagatgagaaaattggaacatggaagagtgaggtaacttccaagactctgggagccgggagccagtaagccatcagagcaggagctcttaaccactctactgtactgcctctcgctactattcctgaactctaatgctaaaaaggtgttctgtatcctgaccaattagactctcccttcaactaactgccattcctggtcctgtcctgcctggccctggtcaccaagtcttggcctgcaccttttcctccccaaacccatcttctctaggtgaaacctctgtcactgcagcatttgtcatttgacaggttcccaaaccctcttccttagttcatcacgtcctcttgatgtgtggctcctaacactcccaggaagtaagatgaagttaaagtgttgaaatgacatgtccccctgcttacagtccactatgactcccaggcagaccagtcatcactgcctgaacatcaagtcaggccttcctgtgcttacggaaatagaagggggcccctttacatccaccccttccaaagtttatcctgttgctcctgacctgtcattagagctctttgagggttttctaagcccgattctgttctctaaagcgcaaacaatcccttgtctcatattgtctgtaaacctgaagagcgtgtcttctacctcttctcctaagtcaatcaggggctttcctcaagcagtcatctgtctattaaccttcggataaggcagttcaatgcatctgaaatccaatgcctggcacccccctctctgtcccaaggtgcgaagacagcaagtgggctacagtggagagagcattagtgctgagttatatgacaggtacacccccagctctgtctttactatgctgtgtacctctgggcaacctgctaccctctctgtggctcaggctttctatctgtgagatgggactaatgaccatgtgccttctttaatggcagtggcaatgctgagatgagggagcaaatgtaaaagacatttgtattatacacaccaaaatgttacctcttaggggtcatttctactttttttattgcttatctgattttttttttttttggtggggggggcggggagacagggtctcactctgtcacgtaggttggagtacagtggcatgatctcggctcactggaacctccacctcctgggttcaagtgattctcccacctcagcctcccaggtaactgagactacaggtacgcaccaccacacccagataatttttgtatttttagtagagatggggtttcaccatgttggccaggctggtctcgaactcctgacctcaggtgatctgcctgccttggcctcccaaagtgctgagattacaggcatgagtcatcatgcccggctgcttatctgatttttctacattttctaaaatgaacatgtgctgtgtctagtaagcaagttttttaaaaaaaggttttacaagcagatataaatgattgtagaaaataagatgaagtagaaaaagctgaagaagactacctcaagatccatgtcatggaattctctgcagatgcccaagagcagcaggtggcacagacatggtgccatggcaggatggccgtgacatacagccgaagaaaacaggaagtggccgagctgcgcatccgcgacacactcattttgtttaagacactgatgcagagctacacacacttgccccacaacctaaactactgggaggggaaaccagtctaagaacaggagggaagggagaatgagggggactggtggggagataaatacctttattcatgtttgtagtttaaattgtttttaaaacgagcatcaacatcttttgtaataaagtggagtagaagagtcaggagtcttgtaaatggatctcactcgagtaaaggcagcccaggagctgcaggcacatactgacaccagtaaagaagcaaagctctcctgctgctcaatctcacagaaatgtttagtcttgttctcagtcctcctgtccctttccaagtgcatgcctagctggttgctttctaaggtcccatataagcacccacttaacaaatatttgagaagcatgaagtccccaagaaaggaaaggaagaaccagagtgaaaggacagataaaacaagaggtttcaaatctcagggagcccagaaagacttcttaagcatcaaagcaccctagagattcagaaaattggcccatgctgtcacctcccaattctcacataattctgacagcagcttctggattttatattatacctgcatgacagcccacttctcagtaagaacatgggtcaaaaactgcaatctcactcctcaggactcagagccaggaggaggggtatgcaggataagatagggaaatgccagaaccggagtgacttattgatgacacttggggaatacattcagagagtgcaaggtctcacacgccaggtcatgttaggcttctaaccagtctggatctcagcccacctagcaggagagagaagggactctcttgaaagagtcaggaaaagcactgccactgttcactgagcaagcattacaagcagtgatgaccgggagtctgtctataaaccctgtttcctttcggggctctccctcccaagatgccccctccctccgctcctgcccacttggctgccagagccctgggggtctctccatgatggtggccatgagccaggggaataagaactccccagagctccccacagggcccatacagcaaagcctatgcctcaccaagccactggccctggtcctggccctgaatttggcccccttcctggaggcctatgaggatgaatagtgtaaagagaggtaacaggaacctcagagggctgatcctcagggtctctcagttctatagcaacaggacaacatgaccttgacaaggagcaccatttcctgcttcagccggagccagtttttcccaaaacaactgctctggggaaggacaccagggtaacatgaggagcagacactgggtctttctacttaccaagtgctcaggtgctactggccctggggatggctgctaactggaagatgacaggttggtgggctgctggtgggtcaccagagcagaaggtcactaagagccattctagagtgctccagagtcgctgtcacagctctcctttctcgctgcctcctcaagaacctccacccaaatcctggggcgtcccgagcacgtaggcggtgtctccccacccacaatgacctgcttggcaaggcttggcacacctttcccccattaatgcttcctgtctccctctctcccccgaggaacccaggcaggctgaggcaataccttccttcatccatctggactggccttggaattcctgggccaatctggggatcccatgcatcaaccctaaagtgggccagtgccaggtatgtgcagcctgtacttcccagtctgggcaggcggaggctggaacggtgccagcaactcacctctgcaacacagcatggaagcatttatttcaagggtggctggggagcgtccaacagcccgcctcccagcttgcaggacagcctgccacatgcaggggaggaaccagtttgctttgggcaaactgcttcacttctctgagccacccttgaaataaatacttccgtgctgcgttacagaggagagctgctggtgcggttccagcctttgcctgcccagactgggaagtacaggctgcatatacctggtgctggcactggcccatgttagggttggtgccagggttccccaaattggcccaggaattccaagggcagtccagatggatgaaggaaggcacctctctcttccctctcacctgtcagggcctataaggcttggtgctcttctgcttggttccgagcacaacatctgagtggtcagtgccacaatcataacaaccagctgcctcacaaaggaggcagcttggcataaggacaagggcagggctttgtccccagacaaaaatgggtttgaatcctagctctgtcactcactagctgagtagctttgggcaaactgcttcacttctctgagtgtctatttccttatacgtacagtctcacatagctcagaaatgacttggctatggtcacagggagagatggctgtagagcttggtcccaggtcctgacatactggcttccagagcttgtctgactatactaggatgtttcttaactgcagctacacgtgacagagaaaacagtcgtctcttttcctaaatggctgtcagcaattcccaaagtcagggaaaagttcctttcgaagttcactgccttaatacaaaagtagccttcacagatgccaacttaactaggtgaatcaagttagcatcacttttactagggccaactggcaccactgtgcctcctgatgtaagcaacaggaagcacacctcatctatgtgggttcccaccaacaacgtaaacccgaatctaatcacaaggaaacaatccaacagatatggaatgtggacaatctatgacacatcaagcaaatgcgccaaactgttagcaactggtgaatcttggtgaaggaaatacagaaattcattgttttattcttttaacttttctctagttttaacctttaagagtaacttttaaatattaaatatgtgtagtattactcttaaatcattaagtgatttttatttggtattcattttgtgttaatgctctcttccgcattttctattatcagatgtctatatcagatagagatcatttttacatgctaatgaaatatatacaatcatatatcacaatatatttgtccataataacaataaactatgcatttattttatttttattattttaattttttagatggggtctcactctgtcaccaagactgtcaccacccggagtggtgctatcatagctcactgcagccacaaactcctgggctccagtgatcctcctgcctcagcctcctgagtaactgggactacaggcacatgccaccatgctggctaattttttttatttttaatagagacaaaatctttctctgttaacaggctggtctcaaactcctgagctcaagccatcctcctgccttggcctctcaaagtgctgggattacaggtgtgagccactgtgcccaaccaaaccaccaaaccacgcatttaatgttacatctttttttctctttttcttttctttcttttttttttacagaaacacctctgaaattttatcacagaaaaaataattccatttattattatgaccactccttatttaaaaactcataaagtgttaggaaagatatagaaaaagttatgattttgggcattccagggaatttctattacttgttcctcaatcctgaaagttaataactgttgggaatttggaagtaccagcatcttgatggccagccttcgttatgacccctgctcccacatggcaacattccacctagtagctccagccagagagccccactcaaataaaatatcatttatgggactgtttcaggcaccatgtacaaaagcactgacctagacccctatggggagagatgacaaaaggagtaaaacacagcctgcccttgaagaggtaagtatacaaactgtgtgatggagggcacataagaggtggccactgtggaggaagaaatattccaacttgggagcagcagggatgattctggagtaggtgtaatggccctttcttctagctgggccagaaaactagaaaaggcactcccagggaaggccaaggtgagtcaggcaacgcagccgagaacacagggcacatctgggaatggcgagctgtccgctttggctggggcaccccactctctgaaggacagataaagggccaggacctggctagccttgaattcctagtttctaaggtgtatagacttaattttgaggcccggggttctgccctctggttccaatgactgtaagagtggagaggggcaaagaaagtcaccagggcccttcagaaatgacacagtgagagagggtgagggtctgaaatctcatctctcaccctttcaaaatgatacagttcctgtattttcccaggcatagctctttgcacactttcttgctattgcattttacttctttattttggggaatatgctatttatttgcctgcttgatttataattggggtataacatactcatggttagagtatgcaatctgcattaatcttaaacataataagccccatgaattcctacatttatataccaccataaaaccatcacccaggctgggcgcggtggctcacgcctgtaatcctagcactttggaaggccgaggcgggcggatcacctggggtcaggagttcaagatcagcctggccaacatggtgaaacccctgtctctactaaaaatacaaaaattagccgggcatggtggcaggcgcctgtagtcccagctactcgagaggctgaggcaggagaattgcctgaagccaggaggtggaggttgcagtgagccgagatagtgctattgcactccagcctggggcacaagagcaagactccatctcaaaaaaacaaaataaacaaacaaaaaacaaaccaaaaaaacccatcacccaggtcaagacagtaaacatttccagcaccctacaaggttctttgtgcccctgaacagctaatctccacaataagtaactactccgctttttttgagacagggtcttgctctgttgtccaggccaagctggaatgcagtggtggcctgatcacagctcactgcagcctcagcctcctaggctcaagctatcctcccacctcagcctcccaaagtactgggattacaggtgtgagtcactgtgcctggctgtaaaccactcttctgacctctatcaccatcagctagttttgcctgctgttgtgcgtccagtttctcctggttggagtcagagcccacagagggcaggcactgagaggttcctgctgccttgtggccctctacagtgctgggcacgcagcaggcatttagatgtctgataagtcaatgattagaccaggtggtggaagcgtgtccatggacaccgaccctctgccacatgtttgcaccttctgcctatgctgctctcctgcctgaaatgcccgcctccccttttcctttgtctcattcctaccttcccctcttttgtttgagacagagtctcactctgtcacccaggctggagtgcagtggcgcgatctcggctcactgcaacctccgcatcccaggttcaagtgatcgtcccacctcagcctcctgagtagttgggattacacgtgtgcgccaccacgcccggctactttttgtaattttaatagacatggggttttgctatgttgcccaggctggtctcaaactcctgacctcaagtgatctgcacacctcagcctcccaaagtgctgggtacaggtgtgagccactacacccggcctcccctctttttgagaaaaaggtttggctcaagttccatccccttcccggaagctctccccttcctgcccccgcggcacgtgctgcccaccaggctcctctgcagatgctgcctctcatgttctctctgagtggatatgtgtgcacatctacagcctgctcctcatcctgtctcagtctctcaaaggaaagatcctgttttagtctgcattaaatgagccccaactcctctcacttcctccttgtttgcagagtatcctaagctgcaaaaaatttcttctggtctgtcttcctcacagggctagaaggatcgcactggaaaacagctatgaagaggttttataagccacagtccacctaacatacatcatatgtacaacaaaaaagctttaaaaaaaaaaaaaaaagaatggccaggtgtggtggctcgcacctgtaatctcagcactttgggaggccgaggtgggcagatcatttgaggtcaggagtttgaaaccagcctggccaacatggtgaaaccccatctctacccaaaatacaaaaatgagccaggcgtggtggtgggtgcctgtaatcccagctacttgggaggctgaggcaggagaatcgcttgagcctgagaggtggaggttgcagtgagcagagatcgtgccattccactctagcctgggagacagcacaagactccatctcaaaaaaaaaaaaaaaaaaaaaaagaatgcagtgtatctgtatatgctgatatggaaagattcccaagatacactcaatcaaaaaaaaaactaactaggtgtcagagcaatttagtgtgctccccactgccacggtgaagagcaggatgaggataaaaacacacgcacatgagagcgtgcatggaaaaaccgtggaaggaacgatacccaggaaaccaatcaccttcaccttcacccctggggctggggtgggagatcctgagtccagtcagtccctttctgtcatacaacattctgatctatgtgttattttgtattaataaacattttaacataaaaataaactaaaatgaggggctgaacttataccaccaccacagtgctccccagcttcctagagttcatcctgagggtaaaccatgggcagcttgctgaaacctgggctcgggccccagaagccacgcagatgctgcatggggtcagtcagaaattcagcacaagtcaaagcagagagaagaaaacatcctgtgagctcaccgacagcaacccctgggggcctggtaaagagcaacaactgatgcaactccaccttttgcttggtagccaaaacctgagagctcagagcctagggccaaaggggaaataaggggcccagggccctctgtgggccaacactgccgaccctgttgtgtgacccaaactgatccaggactggatcaatttccagtttatatatttgtcaggaggtgggggaaagcaggtttcccccacctcctgacaaatatataaaccaaggttaggagatgcaatctaagggaaagggcagaaggaacaaagacctccagggtgctgctagtcttcacagcactaagggtcccacacagcacaagacagggcctcctgggaccagaaaccatcctgtgctggaaatggtaggagaaagactacagcaacctttttgcaaggctaggtctgtctctgtctctcacatctatagagcagcccattctgaagccttgctcttcaccttgaggagttcatcttcagggttatcaacaaactcccactgccaggccaacagtgaggtagattctatcatcattttcctattttatgtctggtggagtcttggcaggagtcttgaccttgaagttagtctccttgaagttattccgtcatctccaatattccccaagatccaaaaagccaagtaccaaatgaaccaagtatttgtttgtttgtttgtttttaagatggggtctcgctctgtcacccaggttggaatgcagtggcatgaccacagctcactgcagcctcaacctcctgggctcaagcaatccttccacctcagcctcccaagtagctgggactacaggtgtgtactgccacacctggctcactgaaaaaaaaaaaaaaaaaaaaaaattgtagaggtggggtctcactatgcatcgtggtaagagagcacgatgcaaagaatgcaaagggccttgaaaacgactaagaactacaaatacaaagcattagaaccaccaccagaggaacactgctttctcctcccattttgaaacagttctcttggaggtcctggatgacctcctctcgccccgccatctaagaggcccttggctgctgccctggtcctgcttccatctcactgctgcaatgattctgtcaaccacttcctcccgaggacaggagggtaacttgcccagggtcacagtccaacctcataaggatcgcccttccctctgggggctttgcactctgctgcttgttcttccctcacccgcccttgaaatgatgatcctcctttcctacccccaacgccctccccaccccattctgttcttggctggcttccctgctcaatccatccgctgcacaatccaaccactggcaatttcacacaccgggactgcatcccacaccactgtccggggcctctctcctgctgactgtctaaataccacacggaggcctcgcaggggccttataatgcgttcaaaacacagtcaattatcttcatgccaggccacaggagtccctggcaggcagcaagttacccatttgtttttttttttttttttttttaaatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccgtttaaccctgagtggacacagcacatgtttcagagagcacagggttgggggtaaggtcacagatcaacaggatcccaaggcagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccgtcacctcccggacggggcggctggccgggtggggggctgacccctcccacctccctcccggacggggcggctggcccggcggggggctgacccccccacctccctcccggatggggcggctggcctggcagaggggctcctcacttcccagtaggggcggccaggcagaggcgcccctcacctcccagacggggcggctggccaggcggggggctgacccccccacctccctcccggacggggcggctggccgggcggggcctgacccccccacctccctcccggatggggcggctggccgggcagaggggctcctcacttcccagtaggggcggccgggcagaggcgcccctcacctcccagacggggcggctggccaggcggggggctgacccccccacctccctcccggacggggcggctggccgggcggggcctgacccccccacctccctcccggatggggcggctggccgggcagaggggctcctcacttcccagtaggggcggccgggcagaggcgcccctcacctcccggacggggcggctggccgggcggggggctgacccccccacctccctcccggacggggcggctggccgggcggggggctgaccccgccacctccctcccggacggggcggctggcctggcagaggggctcctcacttcccagtaggggcagccaggcagaggcgcccctcacctcccagacggggcggctggccgggcgggaggctgacgccccgacctccctcccggacggggcggctggcctggcggggggctgaacctacctccctccctgacggggcggctggccgggcggggggctgacccccccacctccctcccggacggggccgctggccgggcagaggggctcctcacttcccagtaggggtggccaggcagaggcgcccctcacctcccggacggggcggctggccgggcgggaggctgacgccccgacctccctcccggacggggcggctggcctggcggggggctgacccccccacctccctccctgacggggcggctggcggggcgtggggctgacccccccacctccctcccggatggggctgctggcctggcgggggggctgaccccccccacctccctcccggacggggtggctgccgggcggagacgctcctcacttcccagacggggtggctgccgggcggagaggctcctcatttctcagacggggcagctgccgggtggagggtctcctcacttctcagacggggtggttgccgggcagagggtctcctcacttctcagacggggcggcggggcagagatgctcctcacctcccagacggggtcgtggccgggcagaggtgctcctcacatcccagacggggcggcggggcagaggcgctccccacatctcagacgatgggcggccgggcagagacgctcctccttcctagatgtgatggcggccggaaagaggcgctcctcacctcctagatgggatggcggccggtcggagacgctcctcacctcccagactgggcagccaggcagaggggctccccacatcccagacgatgggtggccaagcagagacgctcctcacttcccagacggggtggcggccgggcagaggctgcaatctcagcactttgggaggccaaggcaggcggctgggaggtggaggttgtagcgagccgggaccacgccactgcactccagcctgggcaccaccgagcactgagtgcgcaagttacccatttgtttgctgagctgatcaccatatgcttctttcccctcctgccaccccaactgctccacctctagtgcttcccacccaagtcaatgggacaccatcccttgggcacacaggctgaactccagcaccagtgggtcctccctcaccactcaggtatccattctcccctttccttgactggccaggttcaagccctgcccactcctcacctagatctgcctctccactcctgtcagtgacatttctaagcccagccatgacctgtcacacccttgcccacaaaatccaactccttaatgtggcatccaaggctttccacactctgatacgggtgcagtcgctgcccagtgggctagtgggctagcactaccagtagcactaataataataaaaataacaataatgatgataataacaacaacacatactgaatgcttcccatgtgtctcttcatttccatcacagccctgttggggagggtccacaggatcaaaatttgacagatgaagaaactgaggataggatggtaacttgcccagggtcacagtacaacctcataaggattgcactgtgccagaacaaacgatcttttaatcctttagccttctctgacactttcaaactccttaggggctgggatatgcctgtttagaaaatctctgcagcaggcttcccattgcctctctaacttcccaaaggaaacagcaatagatgttcttgggatcaaaatgaaagataatgtgggtctcccaagttattcctagaatttttgagttctaagaaggaatatcaatgtctaactgtcaatacattttatagtaagtagaagtatttttacacataattaacactatagcataccaagacctctggttaaattaatgtgggtgaaacaattatacccatttcacgggacctggagaattttactgctccaaaatttcattttatggcaagcacagtataggtgatgccaggtgcctggttagaacatgcctcctgacaacgaccccattcctggagtaaagtctcctggcagtgccacggcatgtccaggaacgaatgctctcctgccacaggcctctaattgcctaatggccctgggacttggctcttcaaacacatggctcccatcccagagcttcccactaggccaactgtttctgtttcctaaggttctaggggctactgctgacgtcagaatggaggggcaaaaacaaaccccaacaacaacaatggcgacaatgacaaaaaggagagagcagaagaggaaacaaaccacaggcaagaatgtctgcatgacgaactctagaatgcgcccttggagggtatgtaagatacccacttcatgcctttctccactctccccctcttcctcacccatcctgtgtactgtacttgtttacttatctatgtcttccctctggaatggggcaccttgactgttcttcataactagtagattgtaggtgctaaattaatgttgaatgaatggcggcagaccttgctaattgtttacacaatatccattctccccttctttcttggtgacagaatcccaattctacctcaggtagcaatgtgctcagctaaatgatgtctcagcctcccttgcaactaatggaggcaaggaggagaagctgaagctatttggtgggacttgcaggaaagctccttaagatggagcatgtgttctttttgcctttcctctcttcttcctgctttcttcctagaacctgacatgatggttggggctcccgcagccatcttagaccatgatacaaccttggggttggacgccctgcactaaggatggcagagcggagagacaagccctagactgtccccctagatttcttttcacaatagaaaaaatttctactggtttaagccactgctatttctgttctagctgccaaatagaattcctaactgactcatgagtaaaccaattaaatttagttttcttaaattactcatcgctgacctacagtttacaaggccaatcaccacctctaacctctggtctttgtaacgtaacgataatttgtcattacgttacaaataattattgttcactggaggtcaggaggagggaaggacagaagcactagaaggaagaggtagttcaaggaggaggaggagacactgaaaagccagtggccactggctggttttaagtctctgaaaagaagatgagggacagaggcaggaggggagcaggaaaatgaggtgcacggaagagaggagatgaggggagaatgcagagaggaacagatgcaaaaggcaggagcaaaggaaagtggagcctgacaggcaaggtagagaccctggagagatggagcggtggagagaggagaaagagaagtgtgctgcagcagcaattgctgctatgatttagagaacaggtgctgcaggctgggcatcagcaccaagcactttgtatgtatgtgtgctccctgatcctcttgctcctgcactaagtgttaccatgcctgttttacaaatgaggtaactggttgggtgcagtggctcactcctgtaatcccagcactttgggaggccagggcaggaggatcacttgagcccaggagttccagaccaacctgggcaacataacaagacccccaatctctacgaaaaaatttaaaaattagccgggtgtggtgcatgtgcctgtagttccagctactcgggaggctgagcagggaggagccctgcttgagcccgaaaggtcgaggctgcagtgagccgagattgtgctactgcactacagcctgggcgacaaagtaagaccttgtctcaaaaaaaaaaaaaaaaaaaaaaaaaaaaaacaaacaaaaaaaaaaaacacgaggttaattggctctgagtatgaattaactttccctcagtcacagaaagtggtagaggcaggctttgctgaagtctccttagaagggaggtgagacatcattcttctgtcttcttctatctcactgtgagatgtggaaccacggcaaccattttggaccatgaggacagcagccacaccctaagaatggcagggcacagaattggaaggagtctgggttgctcatgacctaatggagcttccacaactgtctgagactatagactacctaactcagtcagaatccctatccatcaatccatcaatccatccataaatgcttcagatcacaatttgctacattttcctctaatcttcagtaatagattccaagtcacactcccagacattctgattcagcaatcactttgagatacactctcctagaaaaatggaaaatcagattcattgaacaggtaaagaaactatctgagactccacaggacaaaccttgatacctcaaaagcagcaactgctgatgacgtgcccctagaagaccttggagattagcagatgacactgcaaagttaatctatcataatttggagaaatggaagaaaggaaaagttcataaagaccaagagagagcacatttggggctattcctcagaaacagataaaaggtagtcctagttaattcagaccagtctgtaacagtgccagcaagtcatctgagaaaaaacaaacgaatagtccaagcctcagaaagagaacagctccttttgggcaaaagcaccaagttgtcaaagggacacacttgcatgcagtggcatcagacagcattactgttgggcaccactggttgcagctttctgtgtgctaggaattctctccaactagagtgcaagctctcctctctaagaagagggacttgtggcattactatttccgtatcttcagcaatagcacccagcacagtactgaacacatagttgcttaatatatgaccacagactgagagctgtcaagaaagaactaatgggattcacgtgggttgggcaaagatgcctactgcaagccaggcgcggtggctcatgcctgtaataccagcactttgggaggctaaggtgggcagaccacaaggtcaggagttcgagactagcctgggcaacatggtaaaaccccatctctactaaaaatacaaaaattagccgagcgtggtggcggatgcctgtaaccccagctactcgggaggctgaggcaggagaatcgcttgaaaccaggaggcgtaggttgcagtgagcagagattgagccattgcactccagcctgggcaacaagagtgagacgctatctcaaaaaagaaaaaaaaaaaaaaaaagaaagaaaagacgcctactccaagccctaaccctgtgcccacctctgagttcaagctgattcctgaaattccagccaagggaattgagagttggtgctgtcattgttcatcactctcatgagactgttatctgatggataatctggggatctttaaaggttcgattgccttctcttctgagaatattcctatgatagagtctcaagagtccagagaattcaggcaaagctgaggagaatgacacaggccattaagctctgccccggacctatctcatctgccctttttagttgttaagtcgcagtagggtagaaatcttaacgaggtcagaagtgatgggtgacacagctctaaatgccaggtactgagttttcacatcctggtctcctcggaggccccgggcatacagagtcacctactcctaaagcaactgcgcctttcagaagtgcagccttattctaaaattaaagattctcagggcccactaggattataattagtttgtattcctccacctggcactcagagacgctgagtttgggaagggaatgtggggcatgcattcttaagtctggaaaccactttaatttgcaagatttagtggctttttctggccactggcttgttttaagtctctggcatcctcagctagactaagaattgttaccttgtgtcccagccatactgattcacatttccatcaacttggcacaaaatgtgccaaaaaacaagctttcctgctgtcattccctgcctctgcgtcccataccactcccagcacttgcctctactcagccagagaaattcaatgcaattaaactaccaacactgaatgcccaccaaatgacaggtagaatgtaaggagtttcaagtaccaagaaaaacaagaccctgctctcaagggggtcagagtcggctgaaaaaaggagatacgtggccaggcgcagtagctcatgcctgtaatcccagcactttgggaggccgaggcgggcggatcacaaagtcaagagatggagaccatcctggccaacagggtgaaaccccgtctctactaaaaatacaaaaattagctgggcatggtggtgcacgcctgtagtcccagctacgtgggaggctgaggcaagagaatggcctgaacccagaaggcagaggttgccgtgagccaagatcgcaccactgcactccagcctggcgacagagcaacactctgtctcaaaaaaaaaaagatacgtaaacaagcagcgacccacagagtgatagttactacagacagagaccccaagctctgaaggagtaaaggctgctctcctgggagggatcaaggagaggaggggagacaggcaattccagcaaaggaataaacagtgcaattgcgcagaggcctggcagcctcaactgctgggggcagcaaccacagaggcagccaacagggatcagggttactgcatgccggacgctgccattttacagatgagaaagctgagttatggaagggataagtaacttgtccaaaatcataccttatgaaaagacaggttccaagccaaacagctggaccctaaaacctgtgcttttaaacattacagtacatggtatgcaaatagttcaatttgctgaagtgtaaaatttaagagctaagtttatgcaggagaggtagaatgggctgcatcatgaaaagcttcatatgacacgctaagcatttgaacaaactttcagtaggatacgggactaaattaacgtgaaagagcttcccctttccaccactatcacagaaaaataccagataaaataaaacaaatgacgtccgtagacatgcagccaaattggaaagagaaatgcctatgtgcgagaagaattgaaacataaacagtgagtggaactgacaccacaatggcctgtggactttcgcacccacaaatgaagcggtttaaagcctgcctgtggctttgagccccagtatcaagaagagagcctcaaagggctgcccagtaaaggaaagcaacaagaagctgaacacttctccaaggctctgtgggtcaggtatgggtgggaggtcaccctttctttttttttttttgagacagagtctcactctgtcgcccgggctgcagtgcagtggcgtgatctcagctcactgcaagctctgcctcccgggttcatgccattctcctgcctcagccttcccagcagctgggactacaggcacccaccacctcacccggctaattttttgtatttttagtagagacggggtttcaccgcgttagccaggatggtctcaatctcctgacctcatgatccccctgcctcggcctcccaaagtgctgggattacaggtgtgagccaccatgcccggcgggaggtcaccctttcttaagccaccaagctagtcctgcccatggatataaaactgaacttacactactagggtagtaaaggggtgccgcactaagcagtgaacaaaaactgagccaggaccactgaaacactcatggccccgccagaggcaaacaagctgctctgaggtatactttcataattcaggacccaagtctcagccagaaaagagaatccctcctggagatgaactcacacccaaagttacaaaccacacaaggaaataaaccaccaagaggggcaagcctcagacacaaaaagagaagtagcatcccaagaatcagaaataagacagtctcaaagaaactacacaagaaaacttggatgattaaacagataaaggaacacagaaagaacaaatatagagactttggtggtaaaatgctcaacaatatgtctaagaggcattccagaggccactgtagagaaaacgagaaagccaaagaggcaatggctgaaattttccagaacttaagaaagaattaaatgtaagagattaacattaggggaagctgggtgaaggaatacagaaactctgtgtaaagctaagtttatctacaatcattttaaagtaaaaaggctttttctttgttttttcttttataaatgagtcctcagataaaagcagcacaccaaatcctgagcaagaagatggagaacaaatccacacttaatttcaaatgattccaaacaaaagcatatatacatatacagagaaatatattaattgaataagattaaagagaatactcatgttcattgtactatttcctctaattttaacatttttctaagtaaaaggatgggagaaaagatgagaaaatgttggagtaagaacagaaataaaggccaggtaaggtggctcacacctgtaatcccagcacttttggaggccaaggtgggaggagggcttgagtgaggagttcaagacgagcctgggcaacacagtaacatcccatctctagaaaacatttttttttaaattatctgagcatggtggtgtgcacctataatctcagctacttaggaggctgaggtgggaggattgcttgagcccaggaggtcaaagctacagtgagctgtgatcacaccactgcacttcagcctaggcaaaagagctagaccctgtctcaaaaaagaaaaaaacaacggaagtaaaatgtatagaaataaagaaaattccgggccgggagcagtggctcatgcctgtaatcccagcactttgggaggccgaggtgggtggatcacctgaggtcaggagttcaagaccagcctggccaacatggcgaaaccctgtctctactaaaaatacaaattagccgcgtgtggtggcacgtgcctgtagtcccagctacttgggaggctgaggcaggagaatcacttgaacctgggaggcagaggttgcgctgagctgagattacaccactgcactccagcctgggtgacagagcaagactccatctccaaaaaaaaaaaaaaaaaaaaaaaaactcggaaggagaaaaataggcaaaaatggaaatacatggaaagtactaaaaaatataatacagtaatacgttaagttaaatcccaaaaatgtacataaattacttaagacagattgtcagatttgatttaaatccagccacattctgtttatgaaagaaactcctaaacatcgtgacacaaaaaggttgaagagatgaggcagtagcaaccccaggcagcactagtgccatcagacctcacggcaaaaaacaggagtgacattagggaggaaggacaaacaagacttggtggctgattaaaagaggctgaggagaataaagaaatagagggcaactgtcaggtgaccagggggatgtggatgattccattaaggtggggattgtgggaagaagagcaagtctggcaggaaaatgtaagaatcactgggggagtgctgagttttaggagctctggagacccctcagtgaagatgtcccgtaagtagttacagaaaattcttactaccactattaaaaatgtacatatttttccttttctttttttttttttttgagacagagtctcgctctgtcgcccaggctggagtgcaggggcgcgatctcagctcactgcaagctctgtgtcccgggttcacgccattctcctgcctcagcctcccgagtagctgggactacaggtgcctgccaccatgcccggctaattttttatattttttagtagagatggggtttcaccgtgttagccaggatggtctcaatctcctgaccttgtgatccgcccgcctcggcctcccaaagtgctgggattacaggcatgagccaccgcgcctggcccatattttttacttctaaaacaaaacaaaaatccaaaaagcaattgcccactaaacccccccgccccaccgccgagaactaaccatgaccttagcaataaacccatgtttcccatctatgcctggtccatctaagttctgctcctgctgggtgatgtgaaaagtggtgccaggctccaaggtttctggagccggttcaggtcccatgtacagagtggaaaagctctttggaggcaggaaaccctgtgtctgtgcagccataggagaaacagattcaccagcagcagaggtcaggagccagaggttcactactgccaggtggaccactttcactggctgaatcccaaggttcaattcaagtaatcagttacccagtgcccaatcttgacctcaagaaacatacagtaggccaggcgtggtggctcacactgcaatcccagtactttggtaggctgagatgggtggactgcttgagcccagaagttcaagaccagcctgagcaacatggtgaaatcccatttctacaaaaaatacaaaaaaaattagccaggtgtggtggcacatgccagcagtcccagcatcttgggaagctgaggtgtgaggattgcttgagttggggaggtcagggctgctgtgagctgagattgcaccactgcactccagcctggatgacacaaggagactttgtctcaaaaaaaaaaaagaaagaaagaaacaaagaaagaaagaaatgtaccgtagagtgaagaacagtcatagtataagacagactatggcaaaccccacaagagacgtaccaacagctatggagttcaaagaacagaaagctcctctgtgcagtttaggggtacaatcatgttacagaggaggcaacattggaaatgtttttttctccatgtccccttgttacataattacaggggtacattgatccatgcagctgcgtgtccagtggcttgtggcatcaaggcacttaacactctccacagcagaagctggtctctataatagcgatacctaataattattgtttacaaagagtcaggcatgtgttcaatgttttatgggcattctttcatttaatcatcccgattactctataagacattgctatggtttgaatgttgtgaaccctccaaaattcatgttgaaacttaatccccaatacaacggtattaagaggtgtggcctttggaggtgtttaggtcatgaaggctctgccctcaggaacggattagtgctcttataaaagggctccagggaactagctgggccactttcacccttctgccatgtaaggacacagcattcatcccctctggaggacacagcaacaaggtgccatcttggaagtggacagcagccttcaccagacatcaagtctgccaatgccttgatcttgaacttcccagcctccagaactgtgagaaatcagtttcttttgtttataaattacccatctcaggaattttgttatagcagcacagactaagacaggtatgaaccattgttattcccaatttacagatgagaaaactgagacccagagatgcaaagaaaagtttcccaaggtcactgagatagggtcatagagcctgaatctgaacccaggtctaactccagagcacatgctcttacccactttgtcatctatctcatataggcataattccacatgccctcctagacctgtagctctgtaatccattgtcttagccctcaccatgcccagctccaggacaaactgtggagagacaaagacaactgtggcagaatgacatacaagtaggctggatttaagtcacagctcttacactcatccaagcttgggatcctccaagtataggttgagcgatttggctagccacagcatctctctggttataaagctcagagtgggctggacgtggtggctcacacctgtaatcccagcactttgggaagccaaggtgggcagatcacctgaggtcaggagttcaagactaacctggccaacatggtgaaaccccgtctctactaaaaaatacaaaaacttgccgggcatggtggcgggagcctgtaaacccagctactcgggaggctgaagcaggagaatggcttgaacctgggaggtggaggttgcagtgaaccgagatcatgccactccactccagcctaggcaacagagcgagactccgtctcaaaaaataaaaataaataaaaataaagctcagagtgtcaggcacagtgctagacactatgcaatctaattctcacaacaatccattagctccattttccagaagaggaaactgaagcccagaaaggttacaatctgtcaaaggcccttggctaataaatgacagaaccaggattcaaacccagacccaccttagaaaccacacttgtagctgctgtgcacacaacctagcaagtctgacctaggagttagtggaaagggcaggcagtgaactttgcctttggactaggggagctcaaacagagtaataaatatgtaatcactgtgtggactagaagtacagtcactatttcaagccagagaccaacaaggccaggcccagagaggaggtcaatgagcacaggttcatgtacgtctgcagcataggaaagaatctctgcaatgagtttttttccaaacaaggtggtcatgttcacaggttctaggggttaggacttggacatatcttttggaggggcaaccatccaactcactacaggcaggaaaatcagtggggagaaacactcaaaagaacgggaggaacgacctgtgcatggcagaggaatgaggtttaaagctgtcagtaaggctccgggaaactgagagaatgacggattattaacagaaaggggatatgcaaagagcagagacaaagatggactctgcttttaaggctgcacactccagcaggcaggtggacacagggacctggttttcaggagaaaagaactttagtatttggtagctataagagcagatggtcacagccacaggaagggacaagcgcgtggagggagaggagagagggcagaagcctgaagaatgttgacactcaggcagcggaaagaggaagaggaaccagggcagcaaaggcgcagtcagagaggaagggaaacagaggccatgggagaacagacatttaccctcctagggggcagggtccagtctctttcttctgcatcattcccgagtctaacaaggtactaggcatagagtaggcacttggcaaccgctgaagtaataataaaaagcaattatgtgagagagaccaacatgtgagtgatttctaagatgcaaagaaaagaaggtaaaggcatctgtaatgcttgagagcttggccaagttacatgaggcagcatcttctgagagggtgtggggtgagtaggggaaggcctggaagaaaccccaagggaaatgtgatgggaaaaccacgagaagaagaaaagaatgagcagccagctgctggagaaggtgaattctggggccttaactgccccaccatggggctcgtgtgagctccctgctacacacaagagctgccttgccatctagccgctctttttttttccaatcccaaccatccattccacatatttatctaaaaagcagttaccacaactcatcttggggagaagaactgctgtgaaacccatgagcgagaggctgctgctgtgacctgggaagacctgccctgcatccctggcaagttctctggggtgactcttcaccatgggcgggtagcaggcttttccagacaggaagtgtgtggagaggagcagggactgtggccagtgggtgactcatgaagcgtttaccagccatgtgggtgcccaccaccctcagatgggggcagactgggccagttgcatcagacttcctggaagcatttcttcatttctatttttgaagacactgaacttccagagtgacatctctcctgacgacttcaaaaggcactccaatcagcagccataaccagtatcttcttacacatactttatccacccaactctactcactccccaacatgcctgcacacaatagaggaagtggccagacaacacgatgcagcctttctaagggcaacaggaaacgatacaataccacggagccacaatgaggacccgggcagctagagctcccacacaccaccatctttcccaacagccagacccttcctggcccacagacagggtcaggacacagacagcatcaattcccaaactaactggttgacaggtcagagaatatcatcattcaaaagatcacaggacttcctgtacaaattaacccagattcaaaggaacagggagtcaggtacccttatactgcagtgagagggtaaattagtacaactttctagaatttggcaatatggcaacatttattaatatccttacattttgattcattcaaaatttgcacatatacacacatacacatcctttaaaaactgaatacctaccaagtgccaggaactatgccaagtagtaggggagacagagaaggtgactgttctcaaagagcttttgttctagtcacagattcggacaattaaccaataaatcaacaaaataatttctgagtgcagagagcactggctataagagcaaaagatgagaaataacctaaacgtctgttggcaggactgattaaataagattagatattctcataagaatgaataccgctctgctattaaaagtgcattcttgaaaactatattcaaattgctaggatataaatgtttaaagcaggtttcaaaacagtaccatgattatgtccagtgacagaagccaatcacaaaagatcacatattgtatgatcccatttatatgaaatgtccagaacaggtaaatctgtacgtagagaaagcagatgagtggtagtcttgggctggagtaagggcgggatggggcatcgaggcgggaatgcacgctaatggattataagatgtctttttgggactaagaaaatgttctaaaactagattgtggtgatggttgtacaactctgtaaatactaaaaaccatcaaattgcacactgtcaacaggtggactttatgacttacatctcaacaaaactgctaaaaagtaacattcaatatgacttcaatatggttttcaaaaagagggggtgtgaagggtcatgaggggaaggatgaatagccattcaaaacattaaccgtggaaattctctgagaggaaagttctaggtaattttatggtcttccttatatttatctttattttccaaatattctaaaatatagaagtttatttaactggcaaaccaaattatccagggttttaaaatctacttttccaagtgtaccttaagtatgtccaaggcacaagactagaaaggtccaactgctgtgctaacctaggtatctctagggttgtcatattcttcacaccaaagataccaaccagacagccaagcaaaggaatttcatatttcaaataaatcagaccaagtagctcctggttagggagtgtctgctgactgctggaagagcttgctactctctgcaaacactttcaaagaaaaacacccagaggccaccataaagctcagatactatcaaagcatgcaaaacaacatcaaagatttgagcagattcaaatagaaacttcctggacactttcaggagtcacttcctggttgtgaagtgtgaggccctctggacaaatcattctctcccatgtggcctcctctgatcagtgacttcaaaggcatctttctgaaatgactgggctgagggagggtgccagcctctggaagtcattggtttcccaaccaggctgtactcccaaatcaatggggagctttaaaggcaggttcctggacgccatccctgggaattctaattcaataggcatgaggaaggcccaggaatctacattttccccaaaactccctggtgaatatgccagttgagtcaagtatgggactcactgggctggataccatctgggataactcaaaatagggctagcctccacatctggctacaatgcagcaggaatcccacccagtgagcactgtgcatcaaaaggccactaagcgcagaaagggaaactccacagggaaattccatgcatgtctggctatcactgctgaagcttgggggaagctagcaaatccctagagcaaacctattttggaaggttccctaagacacagtgatcttggatgctcatctgtgaaaagggggatgactagtacaacttccactgtgggagaccacaagaaaaatcagccctctccaaccacacaaaagagccagcaagctttgcaactcccaaggaaccagaagcagaaagggatgcagtatggcatgacagactgtgagtctgagtcacacagatctgggttcaaatccaggtatccactaccggctgtctgtggattaaatatggctacaaaccttttgccactctttccatcaagaggtggcgtctagttcccaacctggaatctgggctggcccagtgacagctctgaccaatagaacatgattgaggtgatgttctgggacgtgagcccaggcctcaacacgactggcttccactgtcttggcccccagatgccatgctgcaagaagttcaggatagactcttgaaggattagaggccatgcaaagagaagctgccttggacattacagtgcagctaaacacagacaaatgggcaagcttggccgacatcatgtggggcagaaccaagcatctggacccaattcacacaatcaagagaaaggataaatggtggttgttttaaactactgagtttcacaggtgatttgttacacagcagtaggtaactgaaacactgtttctccttgagcaaatggatttttctgagccttagtttcctcatcaatcagatagggaatgatgataacctgaatagggttgtgtgagtttcaacagaagtgaacgggctgtgaaagtctgaagcgcaggccagtgccagttaccatcactatctgcgcaaacccaatgttcaaaccaccaccacaccaccatatcctttttccacatttagagtctttttgggccaagggtacctcttcatacacaaagcacaggaactatttatactcgccctataattgggaaggaccctgccaacaaatgccccatgttcccaaatcactcaccttctcccatcacatcagtgttccctccggcctctcttcttcctgttacagtgttatctttgccccagccatccaggttcaaagaatcaacctcttacactcctccatttccttttagcatccagggaacggacaaaacctcacctccccagtcacccccacctttccacttccagtgccatcaaggcacggtcatcaaagccaggcaggtctgagtgctgctctgcaacttactacctttatgaccatacgcaagtcataagtctggccatacgcaagaccatatgcatattaatcagtaataccttctttttgtggtcatttcgaagaaagaatatgcagctaaagtatttaatacagaggccggatgcagcggctcacgcccataatcccagcactttgggaggccaaagtgggtggattacttgaggccaggagttcaagaccagcctggccaacaccgtgaaaccccatttctactaaaaatagaaaaattagccaggcatggtggtacacgcctgtagtcacagccactaaggaggctgaggcactagaattgcttgaacccgggaggcagaggttgcagtgagccgagatcatgccactgcactccagcctgggtgacagagtgagattgtcttaaaaaaaaaaaaaagtatttagtactacaggccaggaatttctcacctgtactactatagccatctcctaatctaggcctctgcctgtgtatctctctccattttgacccctctagcataaatgctatcagattaattgtcctgtatagcaactatcacattattctcctgctcaaagaccttccatggctcacactgttctcagatcaatctctgacaacctctcagctaagtatgtaagattgtccacaatcatggctccatctgttgccttggccaatcctatccttactgcaacttgctattagagtcagccttctaaaatggctggcaacaatcctcaccttctggtattcacatatttgtgtaaatctctcctaacccatagaaactgcgagatagtgttttaagctactaagttttggggtaatttgttatgcaggaatagataactaatactcttcatttcccctgtcacacctgagctgttgttcttttcttcagtcatatttgcccttcctacaacatctcagcctgctgaaattctgccaggcctgcaaggcccactcagataccagcgctcactcaccctgagcctttcttaactatcctctggaagccttccctagttccccagtgtctatctccattactgcacctatcacacagaagcattgtcaatctgtttatctgtgtgtaaaatgacaaggttattcattgccaaaaaagactagaagtcacctgcacattcatcaatgaataagagaatggcacatccaggccgtgcatggtgactcacgcctgtaatcctagcactttgggaggccgagatgagcaaatcatttgagatcaggagttcaggaccagcctggccaacaaagtgaaaccctgtctctactaaaaatacaaaaatcagctgggcatgatggcacatgcctgtaatcccagctactcaggaggctgaggcgggagaatcgcttgacccaggaggcagaggttgcagtaagccgagatcatgccactgcactccagcctgggtgacagagcaaaaatctgtctaaaaaaaaaaaagaagagactggcacatccatacaatggatgagccaactgttaaaaaaaaaagaatgaggggctgggcgtggtggctcacacctgtaatcccaggactttgggaggccgaggcgggcggatcatgaggtcaggagatcgagaccttcctggctaacacggtgaaaccctgtctctactaaaaatacacacacacacaaaaattagctgggtgtggtggcaagcacctgtattcccagctactcgggaggctgaggcaggagaatggtgtgaaccaggaggtggagcttgcagtgagctgagatcgcgccactgcactccagcctgggtgacagagcgagactccatctcaaaaaaaaaaaaaaaaaaaagaataaggaagctctacatgtctggtatgcaaagatggccaagatataataagtgaagcaaggtgcagaccagtgagtatagcagacaggtatcaggtatctgcctaacgagtaacacttggggccgggcgcggtggctcacgcctgtaatcccaccactttgggaggccgaggcgggtggatcacaaggtcaggagatcgagaccatcctggctaacacagtgaaaccccgtctctactaaaaatacaaaaaattagctgggcatggtggcatgcgcctgtagtcccagctactcgggaggctgaggcagaagaatcacttgaacccaggaggtggaggttgcagtgaggcgaaatcgcgccactgcactccagacagagtgagaccccgtctcaaaaaaaaaaacaaacaaaaaacaaagagtaacacttgggaggccaaggcggggagattgcctgaggtcaggagtttgagaccagtctggccaacacggtgaaacctcgtctctactaaaaatacaaaaaaaaaattagccaggcgtggtggcatgcacctgtaatcccagctactcaggtggctgaggcagggaaattgcttgaaccagggaggttcaggttgcagtgagccaagatcgtgccactgcactccagcctgggcaacagagcaagatgccgtctcaaaaaaaaaaaaaaaaaaaagttaaacatggaatactatatgacccagcaatttcactaagtatattcccaagagaacctaaagcatatgtccacacaaaagcttgtacatgaatgttcacagcagtcaaaaaatggaaacaacccaaatgtccaccaatttaccaataaataaaatggaatatatacacacaatggaatactcagccacaaaaaggaatacagtactattatatgctacaacatggatgaacctcgaaaacatgctaagtgaaattgttcagacacaaaaggctacatattatataattccattcatatgaaatgtccaggatagggaaagccatagagaagggaagtagattagcagccaagggatggagtaactgctgacaggtaaagggttttttaggtgatagaagtgtcctggaattagtggttaatagaacacagttaatataatatataaacaacacagctaaaataatatataaaaccgttaatataatatataaatatattaatttaatataatatataaaacacagttaatatacaaaaaccatcaaagtacacactttaaagtggtgaatttggttatgtgaactatatcttaattttatgctataaaaatatgtagaatataaaataaaataaactgctcacattctgcctgtggctcaggcatcagtcaccctgtccatgccctccagccccaaaaggctgcctgtctcccccatttttgtgtcccctggcactttctagctgctcactcgcccttcatctcccccgtgacttcccactttctgactcttgggcaaggcctggcccccgcctcactggatccaccctttcctggtgggtccacaccacctactcagacctactggagagcgtctggaggctgaggcaccagccccagaagtcaccccagatgagccgtccaatggccagggctgtagttacaagcgtgtgtcagctgagggatacagtttcacatgggaacttaattatagcttgggagtggtgaagggagaggcggtggcgcaggctttgaggggacgtacaggaagccagtgggtctcaccaggcctgggatcacagcagaacagatatgatccaggcaggcccacaggaacgcacagcctatggaaatcagcctgcttttaagcatgaattcctagcccaacctgtgtgcaggccaaagtggcccagaaaagacctgagaagccactgaccctcagtgctcagaaaggccttctccttgcctactgccagagaccccattttattctgtaagaagtgacaggaaggcatagcttgttccccacaaaataccccatcttcaattttctcccttgctttgagatgcgtttctggaacggaatctgagttactgatgcatggaacatcttcctctatgctcggatccctgcctactgcccagggagatgccaagaagctgtgcagctgctgccacacaggtgtcagtagagcacagtagccagatataccagatgtgtcaaactactggggctgggcactgccaggtgagggaagcagatcaggcagaaaaagagagaatctctggaaagatcatggaaagagtggggccagggtggaggagcaggtgccactgagacacattttcttctcccctatgtctggcccctatctgggccccttattctccaggcgtcttcctggccagcttgcttgctgtttcagagaggtccctgcagtcacctgctgcctaccccgccccaacccatcacccacgcagcttcttctcactgactcaagacagcaccagggacccaggccctcctctcagttgctcttcccaagacccccacccccagccctggcattacccttcctatatactgtctgtgcatctttttttctaaactcctgagagattcatccctaaaagccatagaaagaaaccttcagactggaggtggtatccttttctggatttgtatggaaggaaaaaaaaaaaaggcaggagtggtgagtaggcagagcagatggggcgctggacagggacagggagagacacagatggggagaggcagagtaagacttcatgcacctctctaccctctgcaagtctggcaataacatcaaggaacaaccagacagttcttcccaagtgcctccctccaggccaaatgcctttcccacaaatgggagaggaggtcggaggacaagcagacaccacaaaaccacctgaaaaatgggaaaggcaagtcacaaaactaaatgttaaacagcatcccatttcgaaagacagaaaaaataactaggtatacacaatttgaaaagaacctaggtaagaaaaaaaaatcatatatcaaagcagccacttatgtgtgataatatattacttttttctcctcagtgcttatctgtattttctaatcatctataacgaatgagcattatttatataactaaaacatttttaactaaattaaaaatgccattggtggcatctgattaatttcaaagctcccaaatacagtttcctaaaggtgtcatccactgtttattactagtcagataaacagcttgcaagtggcaggcccttcctccatcacctcgtgcccaacacccagaaccacctgtccccatgggacacagacccctaccactccagagctcatatccaaaagccagaccctcagcaaggtgtaaaactaaacataaggtttggtggttacaggcatccttaggccagaagattcctcgctgcactgccctgccttttccagggcccaggcaggggctggcaggagcacactccaggctgctgtcactgggaagtaccctgtggggctccacaaacaatcactggactcaggttaatacctacgcaggccaatgttcagatgaagaggacgacaaaaataacattaaagttatttttctttttttattattattttatttttttaaataaatagacactgggtctcactacgttgcccaggttgatctcaaatgcctgacctcaggtgaccctcccaccttggcctcccaaagtgctggtattacaggtgtgagccaccatgcccagctgccttgaagttctgtttggtctaaccaataatgactggcatccacctatggtgctgggtgctgagggtctaaagacactaatgaaacaatcatcattcagtgagtgcctcctctgtgcctttacatgtatgagctcatttaatccccagaggtggagggtctacagttatcacccccatgccacacagagtctggctcttaagcactaccccatattccctagaagtccgtaacctaaccctgagaaacaggcagtgagctactcccttctctgttccaggaggaagctcatccccctctgagaagccaaagaaatgagaagtgtggctgtttctctgtctcgcctgccctcccagcctctagctacccgagctctatgatccctggggcctacagctggcctgaggaggagccagcagggcaggcagatgggcacagttcccagagaccagccaaggccaccagtgagatgccatctatgcctgcctcttctgatttctagcgccatccctgcaccccagcccctgcatccaagccaagaaatgggaacagaaatagaaaaggctctctaaaaataaatcggggatggcaaggtgcaagaaaagagaaaaatataatgccactgctggtttgggtatagtgagtcctgctagcttaggcagggcccatgttgagagggcaagtaccaagagccctggctccctttcagcctctgctcacaagcctgtggatgcaacacttgcataactatttgcacatacctggagagcccatgctgaggtgacatcagcaagaacagcagggctactgaactgagaagaacagggctcaaattccaattccaccacttgttagctgtttgacttgggcgagttaacctctctgatcctacaccttgtctgtaaaatgagactaccactacacacctcttgcaggctggtgtaaaaggaaggtgatctcatccgtggggtaacgactggcctaagggagaacatgaataaaggcaatttccctcccttatttctctccctatgtgcacatctgggccaacttttctcttttcacttcaccagactgaagctgttgattaatcacagcagagattttttttttctcttaagagttccttccaccctacaggccgggcccacagcttggctggccagtctcttgtggttctaggggctgctcactgtcttggagcagatccagggagccagtatgcacgactattctcagggcctcctctgtccactgacctggaatgagactctgcaggaggccccaaggcctgccaaaattttgcctcttctcagtgaccaacaagagactgctattttctgaagccaacagcagtctggccagtcaagcaggtactttccaaactggaacaactagatccagccagccatccttcctagaaggccctgctatgtagtgatcaaagacatgggctttaatcacttgggttcaaatcccagctctgccattcattagctgtgcaactttaggcaattttcctaaccagtctgagcctcagtatcctcatctctaaaaggggtacaatggttcctacctctcagggttgttgtgtgaatcaaagtgatatatgtagtgatcagcacaatgcattcaacatgtgggagccatattctactcagatcgttactaggttatctaccggctcagccatggaaaggggattagacacaggtggggatagaagtcagctgtgggagtcccactggggagaccaagaggggtgaaatggaaagaaacagcgggccaggggggttggacttcctcatgggctgaagaaggccatggaggggaacctctcagaaaccacccagaactacgcggtgaatggccagcctgcactgctagatacacagtgccatgccaacactgccatggaactgctttcatcattcagaaagaggaggctgctttttccccctcttctaatatttttaagtgactatgtttgcctgctggtagtccctaagtatgatgggataaatatcccatggaaaggaactgaggaacatgggcctaaaactcgtgaggtggtgtgagggggaggagaggagaaagaaggggcaaaatgccaagcaaagtaaaagctgttatggcacttcagggccaccaatctcgtctctaacttcatctcctggtctcctccctccctctgtccagccacgctggcctcctcgctatgcgttgaacacctcagctgtgtcccagtgcagggccttggaacttgctttccctctgcctgcgagattcttcccacaatagttcactctcctctttccacttaaatgtcaccttcgtggtgagaccttccccggccctctatgtggaactgccactaccctcctttctgcttagttttctagagagcatctgaagccatctcacatgctgttgacttaactctggctccctccacttcccccacctcagttaccacgagagcaggagattttttatctgctttgtttatcccttcatccccagtgcctagcacataggaggtacacaataaacatttattgaataaatggaagaggagaggggaagatggaattagaatcagattttaataatcctacatcctcactggtctgaaagaactctttgttcatgatatcactgaaggtgctgggagagttccaaagcaaggatcgggtaccatatgaggctttctctcttgcttccaagaactccccaacaggttcccccaaagtgcagattgtttcaaatactggttcaggaaaatgctgggcctatgctctccttgtgccatgagagggacgccttaaaataagaacagggatcagccaagccaccacttgtacctggaggcagatgagccctgtattagtttcctactgcactgtaacaaattaccacattaccacaaacttagcgacttaaaacaaaacacatttattctcttacagttctagaggtcagaaattcaaaattagtttcactgggctaaaatcagtgtgttggcagggccacacttcctccagaggttctaagggaaaacagtttccttgccttttccagcttccaaagctacgttcgttgcatttttggccttctcttccacctccaaagccagcagtgtagcatcttgctgcagtagtcacattgcctccttctcctgtgtccaatctctctctctggcccccactcataaggacacttgggattgcatttaggggtccacccagataatctaggataatcccctcatctcaagatccttaatttaattacatgtgcaaagtccattatgtcatataatattcacaggttacaggggttataaaggggtatattttgggggccactatttagcttaccaccaaggaagcaagctccaaaagtttggaagaaacacagttcagatccctggtccacatgaaagaagtgtcagattaggagccttggcagcgtccccaggccagggtctttctttaactgtaactgcttgctatttaaataggcagcaggccaggcatggtggctcatgactgtaatactagcactttgggaggccgaggcaagtggatcactagaggtcaggagtttgagaccagcctggccaagatagtgaaatcccgtctctactaaaaatacaaaaattagctgggtgaggtggcgcatgcctgtaatcccagctacttggaaggctgaggtaggagaattgcttgaacccgggaggcggaggttgcagtgagccaagatcacaccactgcgctccagcctggggcacagagtgagactgtcttaaaaaaaaaaaaaaaaaagtaggcagtggagagttaattttacggaactgagcattctggcccttggaggatgtccttgaaagggaagggcagttttctcttctccagtctgaagcccccaacggagtgctgagcactacataccaggatgtgcgtgctgagggtcaaggggaatccatcaggatctctgcactttcctaaaggcttttacacaggagagggggctgcaaagaaatggtctggaccacatgaacaagctctagatcaggatggcagaagtgccgcctctcatgagtgcagcttggggtggagggttctgagaacccatctgggcttggagaggaaaactgatgtggtcagagtgccatgaccaccaggtcaaacactaggaatgggcaggtcaatggcaatctacacactgtgaccaaccctagtctacatggcacctctggatgctaagggaaggtggcttctaaccagacacaaaatgacttggaaaagcacaccctgagaaacataactgctccagggaagagctgtacattgtggacactctcctctgttgtgcagacatcatatgctttctttcttcattggaatatgctgttaattgtaaaccatttcccatcactcctccccaaagccctcaagggcccagtgagataactgaagagagtaaacttctaatgtaagaacaatatgcttctattaccaggtttattgatgtgaggttcgccagtggacccagctgaccagcagtatttagtgaataaatgatagagcagtgactctcaaccaggggtgattttgccccctaggagacatttggcaatgtccgcagacatttgggttttacagctggggaggggagaagagtgtcactggcacttagtgtgtagaagccagggatgctgctcaacatcctacaatgcacaaacagcccatacaagagatgattatccagcccaacatgtttacagtgctagggctgagaaatcctacaccagaggaacaggaactaggaggcaaagagagtcaacagctatgagcatggagatgttttaggcaattaagggaaacaaaggaagagcatgctttgcttgcttgtttggaaaagggggtaatgagtagagagctctggattctgacaaacttgagaacagcatgtttatgaggagagaatgcagggcggcctgctcagctactgctgccatttggagagcaaagttggcttgtacttccactggactggtggcaaggaactctgcctctgcgatcaactcttggatgaggagtgtgccaaaagcagtgataaggatcaagtggtcctagcagatcacaaatgaaagcaatgaaaatcagctgttagataccttttagtatcatgatatggaagtgaacttaagcatgaagcagtttcccacaccacttggcaacctcccttcagcatcctcctacaagagaactctttccaagctgagttaccattagctgtggagaacttagtaacggtctcaggagagctgctgaggtgaccatgaggctgggtagaagttaggagtgaaagaacttttctggggagtctttctgaatctgctgtgattctgagggctgcccgattaaaaaaaaaaattatataagaaagaggtcgggcatcgtggctcatgactgtaatcccagcactttgggaggctgagacgggcggatcacaaggtcaggagatcgagaccatcctggctaacaccgtgaaaccctgtctctaccaaaaatacaaaaaattagccaggagtggtggcgggcgcctgtagtcccagctactcgggaggctgaggcaggagaacggcgcgaacctgggaggcggagcttgcagtgagccgagatcacgccactgcactccagcctgggcaacaaagcgagactccgtctcaaaaaaaaaaaaaaaaaaaaaaaaaaaaaaagaagaagaagaagaaagcacttttttttttttttttttttttttttacagacagggccttactctgtcacccaggctggagtacagtggtacaaatatggctcactgcagcctcaacctcctcggcttgagtgattctcctacctcagccccccaaggagtaggaactacaggcatgtaccaccacgcctggataatttttgtattttttgtagagacggggtttcgccatgttgcccaggctggtcttgaactctggtgtgctgggactacaggtgtgcgccaccgtgcccagataatttttgtatttttagtatagatggggtttccccatgatggctaggctggtctcaaactcgtggcctcaagtgattcactgtgcctggctggaagacaggacttcaatgaaaaaaaaatggggtgctgcaacgcactcccctgaatgccaggagctatttaatggaagatgaggctcccaggctgaggctgggctccctatgcccaagcctgtaaatctgggctggttcagaagtcactcctacctgggctcaccccctcagaacccagcttgacagaaagaggacaagccagcatttcctgaggttcattttaatcctcacagggaagaaaatgaaggctcaggacattcagtcacaagcccatggttagaaggtcagtcaacactggagctgagtcacaccggtctccagcacaaaatccactcaggcctcttcacagacgatgaaatggctacaaatgttcctcaacttataaggacaaacccatcatatgttgaaaacgtcacaagtcaaaaacgcatgtaatatatgtaacctgccgaacaccataacttacttagcatagcctactgcaaatgtgccagaacatttccatgagcctacgggcaacatcatctaacacagagcttatgttacaattttgaatatctcatgtaattgaatactgtactgaaagtgaaaaaacagaatggtcgtatgagaaccggggcacggtggctcatgcctgtaattccagcactttgggaggccgaggtgggcaggtcacctggtcaggagttagaaaccagcctggccaacattgtgaaatcctatctctactaaaaattcaaaaattagccaggcctggtggcagtcgcctataatcccagctactcaggaggctgaggcaggagaatcactttaacccgggaggcagaggttgctgtgagccgagatcacaccactgcactgcagcctgggcaagagtgagacgccatctcaaaaaaaaaaaaaaaagaatggttgtatgagtactaaaggatggggcttctgttgaatgtgtatcgcttttttttttttttttttttttgagacggagtctcgctctgtcgcccaggctggaatgcagtggcatgcactcggctcactgcaagctccgcctcccgggttcatgccattctcctgcctcagcctcccaagtagctgggactacaggcgcccaccaccacgcccagctaattttttgtatttttagtagagacagggtttcactgtgttagccaggatggtctcaatctcctgacctcgtgatcctcccacctcggcctcccaaagtgctgagattacaggcgtgagccatgcgcccagccgtgtatggcttttacatcactgtaaagttgaaccatcataagttggggactgtctgtattaaagaaagggtgaggataccagatgctaaaacccagaagccagtgcctcagggaaacacagaaggcaccagctctttgctaacatgttagccccatacggagccttctctcagcttcaagtagttgctccaatctgacctccttcaaattctttctgctgtgtgcccctcctgactcctttcttcccctacttttgtccctcttcctaccattctctaatttgtcctccccattccttcctctggctccactccttgcttctataatactgaaactgaagcgtatttgaaacatggttagtggtgttaaatgaagtttcacctttcttgctttttatttttgaataatttatgcttaactttttatgtgctttgacaataaaacctaaatttagttgccttctaaagtttgtgaactcttaatctctcctgtgcatcaacagccctaaatggatatggggtagggatgggttattccaccctggctctgggtgcttaatctgtgtggctgaaatatcaaaatcaatacacttaaattgcaaccagaggaactcagatttaatgtgaagaagaatttccttacatttagaccactgcagtcccctacctatcctctctatctccattcctaatctacctttttgcaatattaacaccaccactccttgctccaaaaccactgatggctcccccattgcccaaagaacagagtacaaattccttcacctagcattcaatgtcctccatcaacctattaggaatttcctaactaacagtagcttccaggaatgaaaatcatgagaagatgtgcttttctcttggaagtatcaagaccacattacctcacataaggatgctgaaaagtagtagctggtctccaaggaggcctgtttctctcctcagtgaatcacgcctcttagtattcacacccttgtgtagtcctctccttgaatctgaactggtcctgagaccaagggaatagaggaagtggcactgtgtaacttccaaggctaggacatgagaaacattgacatttctttctgaatctctcaatacattcattttgggaatgcttctgctcagaacccagctctcatgctatgagaagcccaaggcacatagagaggtcatgtatacgcactccattcaacagcatcaagtgccacccatgtgcctaagccagcgtggacacccagcccagctgagccttcagatgacacctgccccgtcttcatttgactatagcaacatgacatatcccaagcaagaaccacccagctgggcccagttaatccacagaaccatgaaagacaataaaatgccaatttaagaatgtcctagatgaataaataaaaactaactttattaaaatctccacctttgatatctgtcttttaaatattctttgtggccgggcgcggtggctcacgcctgtaatcccagcactctgggaggctgaggtgggcagatcatgaggtcaggagttcgagaccggcctgaccaatatggtgaaaccccatctctactaaaaaaatacaaaaattagccgggcattggggtgcgcgcctgtggtcccagctacttgggaggctgaggcagaagaatcacttgaacccacgaggcggaggttgcagtgagccgagatcacaccactgcactctagcctgggtgacagagtgagacttcatctcaaaacaaaacaaaacaaaacaaaaaagaactggctgggcacagtggctcatgcctttaatcccagcactttgggaggccaaggcaggaatgaatggctcgagctcaggagtttgagaccagcctggacaacacagggagacctgatctctacaacaagttaaaaaatgaggtgggcatgatggtgcatgcatgtagtcttagctacttgggaggctgagatgaaaggatcacttgagcctggaagtcaaggctagatacagtgagccaagactgtgccaccgcactcaagcctgggcaagagtgagaccccatatcaaaaaaaaaaaaaaaaaaaaaaaaggctgggtgtggtggctcatgcctataatcccagtaatttgggaggctgaggcagatggatcacttgaggccaggaattcaagaccagcctggtcgatgtagcaagatcacaagacaccatctttacaaaaaattttaaaatgagctgggcatggtagcacatacctgtagtcctagctactctggacgctgaggcaggaggattacttgagcccagaagttggaggctgcaagtgagctatgactgcaccactgcactccagcctgggtgactgagggagatgctatctcagacaaaatcaaacaaaagaaccaacagtatgttaccaatgataaaaatcaaactttcaagagaaaactcaaatttagaaaacgtgtattgaccactgtgagcccgacagcttcccaatacttaaagactttttaaaaatgagatcagtggtgatattaacgaatgtcacccgcccggcctattataacttctaacatggtaaacataagcccttggggtcttcaataatttttaagaatctaaagggactggcgcagtggctcacatctgtaatcccagcactttgggaggccgacgcgggtgaatcacgaggtcaggagattgagaccatcctggctaacatggtgaaaccccgtctctactaaaaacacaaaaaattagctgggcgtggtggcgggcacctgtagtcccagctactcgggaggctgaggcaggagaatggcatgaacccgggaggcggggcttgcagtaagccgagattgtgccactgcactccagcctgggtgacagagagagactccgtctcaaaaaacaaaaacaaacaaacaaacaaaaaaagaatctaaagggatcttgaggccaaaaagtttgagaatgctgttttataatattctaaagttgacttcaaaataagccatctttcgcccaggcgcggtggctcatgcctgtaatcccagcactttgggagaccgaggtgggcagatcacctgaggtcaggagttcaagaccagcctgaccaacatggtgaaaccccatctctactaaaaacacaaaaaattagccaggcatggtgacacatgcctgtaatcccagctacttgggagactgaggcaggagaactgctcgaacacgggaggcagaggctgcagtgagccaacatcacgccacgccactgcactccatcctgggcaacagagcaaaactctgtctcagagaaaaaaaaaaaaaaaaaaaaaagacacatagaccaatggaacagaatagagaacccagaaacaaatccacacatctacagtgaactcacttttgacaaaggtgccaagaacatacactgaggaaaagacagtctcttcaataaatggtgcttggaaaactggatattcatatggagatgaatgaaactagacccctacctcttgccatccacaaaaaccaaatcaaaataaagacttaaatctgagacttcaaaccatgaaagtactacaagaaaacaggagaaaatctccaggacactggtctgggcaaaaatttcttgagcaataccccgcaagcacaggcaaccaaagcaaaaatggtcaaatgggatcacatcacattaaacagtttctgcacagcaaaggaaacaatcaacaaagtgaagagacaacccacagaatgagagaaaatatttgcaaactacccatttcacaaggggttaataacaagaatatataacgagctcaaacaactctataggaaaaaaacgaataatctaataaaaggatgggcaaaagattttaatagacatttctcaaaagaagacatacaaggccgggtgtggtagctcatgcctgtaatcccaacattttgggaggctgaggcaggcagatcacttgaggtcaggagttcgagaccagcctggccaacatgacaaaaccccatctctactaaaaatacaaaaattagctgggcgtggtggcgggcgcctgtaatctgagctacttgggaggctgaggcaggagaatcgcttgaacccaggaggtggaggttacagggagccaagattgtgccattgctctccagcctgggtgacaagagcaagattccatctcaaaaaaacaaaaaagaaaagaaaaaaagaaatatacacctactactatgtacccattaaattaaaaaaaaacaaaaacaaacaaaaaaaaaacttagccaggcacagtggtgtgcacctgtagtcccagctacttgggaggctgtggtgagaggactgcctagggaggccaagcttatccaacccatggcccatgactgcatgcagcccaggagagctctgaatgcatcccaacgcaaatacgtaaactttattaaaacatgagattcttttgccatttttatttttagctcatcactattgttagtgttagtgtattttatgtatagcccaagataataattcttcttccaatgtggcccagggatgccaaaagattggacacacccctggtcctaggtgatatagcagtacccaatcaagaaagaaagaagaggccgggcgcggtggctcacgcctgtaatcccagcactttgggaggccgaggccggtggatcacgaggtcaggagatcgagaccatcttggctaacacggtgaaaccccgtctctactaaaaatacaaaaaattagccgggcgtggtggcgggcgcctgtagtcccagctactcaggaggcttaggcaggagaatggtgtgaacccaggaggcagagcttgcagtgagcctagatcgcgccactgcactccagcctgggtgacagagcgagactccgtctcaaaaaaaaaaaaaaaaagaaaggagaagagaagttcctacctgcgactgggagctcaaggctcagggatgaactggacaactgacccctggaaatgcacgtacaattgctgccactgggcctggctgctgctaaagcaaatggcaaagcaaatcagttcaactcagtagctctccccgctcaggaggtactttgacctcttccctcttggggaacctcagaagtctctgaaactccccccttcttcctccctcacattcccttcagaggaaagcacttggtatgggtttgaaagcaggagggccccccacccaggaccttcctgaaagatctacaaacaacctgacccccacagacagagagacacagggactcaccaccctgtctgacaacaggaaaacctgcagggtgttaaaggcagagaaggggaagtgaagcccacaaacagctactggaaccactgaacttcagagattaaaacaaatcaggcaggaggcccacgtttccccggcccccagcagggacccacaacaacccagccttccaaataggacaatgaacattgtattccctggagctccacttctgagagtttataaaacctgccaggcatcctgagaacatggaaacagcaatgggaacccagagcattgttcagactcttggtgagaacctcctacccctgcagagatggaagaaacaattctgtgtgttatggccagctctcatatataccagcaaaccacagacccatgaggcagagattggatctgttttttactattatcatttcccaagtgcctggcacatagttggcacttaaaaatatttgttcccggctgggcacagtggctcacatctgtaatcccagcactctgggaggctgaggcgggtagatcatctgacatcaggagtttgagaccagtctggctaacatggtgaaaccccgtctctactaaaaatacaaaatttagccagatgtggtggcgcatgcctgtaatctcagctactcaggaggctgaggtaggagaatcgcttgaacctaagaggcggaggttgcagtgagccgagatcacggcattgcactccagcctggacaacaagagcgaaactccatctcaaaaaaaaaaaaaaaaggccaggtgcggtggctcacgcctgtaatcccagcactttgggaggctgaggcgggcggatcacctgaggtcaggagttccagaccagcctggccaacatggtgaaaccccatctctactaaaaatacaaaaattagccgggcgtggtggcaggtgcctataatcccagctacttgggaggctgagacaggagaagcacttgaacccaggagaaggaggtggcagtgagccaagatcacgccattgcactccagtctgggggacaagagcaagacttcgtctcaaaaacaaacaaacaaacaaaatatatatatatatatatatttgccccctaataagagagaatgatggacaccatctttgtggcctggcaccctaggtacccatataggcaaagacgaaagttcgttcatttactcattcaacaaaaatttattcattatctcctctgtgccaggcactatcctagacacaacaggcagcaaaacaactccctgccctgtggagtttatcttttaatgggcgcaaaggtgggaatctccatgctcctgaaaaaactatgtaagccatagactttcaataattacttaataaatgcctatactatgcataagcaactggtaccagatgctgtgacaggaacctggaatctgggaataagccctagtgaaattatttcatcttcaaggtcaggatcttaaatctggatcctgtgtcagtggtggtcagagacccctgagtaaagaaaatgggattacctcgttggtgcatctgtcttcatctgttggtgagcagaagccactgtgtgagtatcacgtgcatgcccaaaacactgtacaacactgcaggatagaaaaaaccccaacagctttagctgacaggtgccaggggccctcaaagcaactctaataagttatacccaccgtaactcaaagagtgttcctaaggtaatctggctcctcgtcggtcccttacacaccaccctgagatgtgattctgagcctgagtcagcaaatatttccccaatcctggaaggagtctgctcactcccaagtaagcagacactggctttgctgattttatcaggtcggcgcagaaggcgcaggcaaggtaagaagggagctgggtagaagctcataaatgaagatgtcctgagtcatagttgatgccttcaccaaagcccctgcagaatgaactggagtcacatgccaatcaccagcctgctgagttatgaaggctaggagccatctgccaaggaagaagacccatatgtctgaaacctgatgcaaggggccatgttctccctgccaggctcaaggcaagctccaagggctcctctgacaccctggaatccagctgttgcaagcagctcctcaccctggctccaacggcagagaaaaatgtgcatggacaccaaaccatctccaagaagcagccattaggtaatctgggacatggcattgacaatggcaccgggcacagggcttctgacatcatataagcaagggcctggcagaacggacaaagcccacagagacctgggtagggaggaagagaatgtttccagtgtgggcaatgctgagcagtaaagctgtgtcctgcaatttccaagcccttcagaggcactggagcaaggcaccactgttcagcttcccagcctgcagagagcactcagggaggtgggcctcagggacaggatatagctgaagcccttagaagtgacaggtccaggctggttgtggtggctcacgcctgtaatcccagcactttgggaggctgaggcgggcagatcacgaggtcaggaaatcgagaccatctcgactaacacggtgaaaccctgtctctactaaaactacaaaaaaaaatgagccaggcgtggtggcgggcgcctgtagtcccagctactcaggaggctgaggcagaagaatggcgtgaacctgggagatggagcttgcagtgagccaagatcgcaccactgcactccagcctgggcgacagagcgagactccatctcaaaaaaaaaaaaaaaaaaaacgaaaaaaaagtgacaggtccaactcctgagagagaggagctgcactatcccaggatgtgccagaatctgcaggccctgaagacagcttgcacaacagtcaggacagctgtaggcccaaagcagaggcctaatggcttcccaggctagtgctctacactgtctatcctcttaccaggccctaagggaaggcgtctaagggaccacaggtcgggttgaaaggctgagtaggagcaattcttcctgaatgggttaaggcatatatcacacaagaaggccatggtgaagaggcaaggagaaaggcacctgaacgagcagtcagtgtaatctcagtgctctgagaggccaaggtgaggaggactgcttgaggccaggagttcgagacattgtgagagcctgtctttacaaaaaaattgttttttaattagctgagtgtggtggtgtgcacctgtagtccccgctactctggaggctgaagcaggaagatcccttgagcccaggagttcgaggttacagtgcactatgatagcaccactgcactccagcctgggcaatagaacaaaaccttgtgtcagaaaagaaagaaggaaagaaaatccagacccagactctgcaaaaatcactgaatggggaaggaatttggtaattgacaatcatgactaccttctcagaaaatgagagtggacaaactgcaagaagctatccatctagggctgctggtgcccaagctgctccacaaggactggccttgacctgttctcaaatctctcacctgccaccacagcagagagcactactaaggggtaagcacggccagaagtaacaaactgctcaaaagagtaaggaggagtccttgaaagccagagactagactaaaaatctgtccaacacttgacctctacctctttagaatgatccactaaaaccctggagagatgctattcacaggaacaaggaaaaccctctggtccagtctacccaaatctttgcaagtgctgcaaagggggtctgggggtcagtggagaagggactggctcaacaacaggccatccacaatcctattgctttcacagaaaacagtgtacaagaggattacaaaactttaaagtctggtcaagctggttcctttggctctccaccgcagctcctaaaggttgccaactcccatgtccaatctggctcaaagacagcacaatcatcaaaagaggagcccctagaaacctggggccaggtgaaacaatgagccttcatttctaaacatgagagtgggtcacgctttcagaatcctccaagatcagactgggtagaaacaaaggatatgttatttcttgaatacttctttagagaaccaacgccaaataaaggagctcaaactgaaggatatgacgagaatcttctgcttggtaaggttaaacatccagacacacatggaaggtggtgggctctcaagccccagagaagatgatctatgtgactggaagcagatgtgtctgctcaagttcctgacaaggtctaactactgcagccccacagcccaccagggtagttatcaatctgatacctcatactatgcctgggcaaagggaacagagctctgggattgccgttcctcctggatacagaggaaattaagctcccagggaaaaagagggacaatttggattccctagattcagaaaagaacaaagaaaaaagagggagaagagactccaagagaacatgttcagtgaccaacatcagaggcacattcagttggccaaagattgtcaaagagatatgagagaaaatcagcagctgtttcaagccaccaataataaaaggggacagatgcccgccagccccagggctatcaggccagcaatctatttcaaaactcaaacgggaaaaaaaaaagttctggagccagtacacagaaaaaaggttgaggaccacaagtattttctggagcacagcttctggagaattctcttagtcctttcggatggagcacagggtggagggtgggagtgagggcagagagaggctggggtatcatggtataagtgtattccacacatccagagtggaaagacacaaaaccccggttcctggaaggggaaaagaattggacaaagcctccggctacccgtggcacacatccagctcagcgccgtctcccccaagggttcctggaagtcaacagccccataaaggggaagtattaaagctgagataagaagaatggcctacaaattggacatcatctctgatgcaacacccacgtacattctcccacacaatctgttatttcctttagtcaatcagcctcttaattcgatcaaggtctgaacacctccacccccaccccatggttatgtcaactgcaggtcaagtgaaagtagagtagagtgtggagctaaggcttctccctgaagcaggggaaaggaacagggagagaaaaggaggtgggcgacaggaatgtaggggacagaattgatacgaaggaaatcggaaaaaggagcaaaaacagggcctctcagggaaccaaggtgagagtcttagggagacagggactgcaggcacggagttggaaaaagcctaggaacaccctggggaagaggatggggacccataatactaggagggatcagaccacagataagaaggggacagggatggggagagagagtaaagcctgagagagcaaggatgggaggatgaaggcaggagacaaggataacgagggggacagaggaaaagatcccagagaagactctcgctagatagggcagtggattcaggaacaccagaaacgggtgaaggaagaggtcagaggcaggggaggggaatgggagaggcccccgggcctgagacggggttctcacaagtgggagaagacgaagccaccaggcccaagagggggcaaagagtagggtggaaggaggcccgtatttcggactcactcaagcagctatgggggtccaagggcgggggggcgcagggtcagcggggcgcctacatggcaacgcacgacggctgaccggagcgggccggagcatcaggaagccgccgtgacgctgtccgcggaccccggcagctccccgcaccccgttccccgccgccgggccttgcgccccagtcccgctggccgcctcggcccaggcccggcgcttccctccgccacttgcctgaccgcttctctcgtctcggactgacctgtcccggctgcctacggcgccaccgccgccgtcccgcaggctccgcagaattctcccgctcctgccaaaacttttcccattaatccccaggtccgcggcggccgcagcgtcacacgctccgcggcccggccccgcccccgccagcgagacgtcaccgcgctgctcggcctttccctccccacgcccccttccgcccggcggcggccaatcaccacgcctcctggagactcccctaattctgcctctccgcccaccgcacgctgccccgggccagcctgtggcgccctctggtgcgggatgcggacgtagcagctaagggaggagcaggggagcgccaggtccagtagaacaagtccagcaagtgacacaagagggaatttaaagctggaagggaatttctaggtcatctagtgcaacctcctcatcttccagtgaagaaacttagtcctagaaaaggtacgtgacttgcagtgacaagtctggagagactcttaacccagtgctaggtccactggaggagatcatatcgcctataattttcaaaaaagggctttccgccttcaagaggcttctacaactggaaatttacggtcttagagttcttaacctttcttcccatgtgcttatgcaatacgcttattcacctaaaataggggacatcctccttattgttgtagaaaattctgttcttattaatccacatctttaagacctggaagggacctattatcccaacctaccgcttaagatgtaccacaggaaactacctagcagctgggaggcaatctggtggaagaagttggctttcatctgacgatgaacaaagcttgactctcaggtatatgaccaatgcctcccctccatcatcattaaagatgacccctcccctctccttcggccacaccttccgtaggccgcaagctccttaggccacacctagctatctggatgagtgatttttttttttttttttttttttgagacacagtttcactctgtcgcccctgctggagtgcagttgcgcaatctcagcccgctgcaacctccgcctcccgggttcaagcgattatcctgcctcaacctcccaagtagctgggattacaggcatgcgccacacgcccagctaattattgtaattttagtagagacagggttttgccatgttgcccaggctggtcttgaactcctggactcaagttatcctcccaccttagcctcccaaagtgctggaattacaggcgtgagccaccgtgcctggcagggatgagtgattttttcccccttctttctgcttctctttttctttttcttttttttcccctactttttgaaatgcttgtgcattatatttgtaacttagatgtcaacctccttgccctttgagattgaggtaaaaatggacggtgaaagtcagagtccctcccttaacatatttgcaaatatctggggatttatattctcctaaatatctctgcctctgggtttctgcttttgccaggctgttgcgtaccacagttcagaagtctggagaggaaactcagctctccctaaggactgcccgcacccttcccacacaaaacattgacgagtacaaagacattagggtactctgggccctgggggaggtcatatgatacatggcaaacagtttaaactcacccctcagaagttttttttttttttttttcccaaggcagaagaatttttcttagtgcagaacaaaatgagaagtctcccatgtctacttctttctacacagacacggcaaccatccgatttctcaatcttttccccacctttcccgcctttctattccacaaagtcgccattgtcatcctggcccgttctcaatgagctgttgggcacacctcccagacggggtggtggccgggcagaggggctcctcacttcccagtaggggcggccgggcagaggcgcccctcacctcccagacggggcggctggccgggtggggggctgacccccctacctccctcccggacggggcggctggccgggcggggggctgaccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcttcacctcccagacggggtcgctgccgggcagaggcgctcctcatatcccagatggggcggcggggcagaggcgctccccacatctcagacgatgggcggccgggcagagacgctcctcacttcctagatgtgatggcggccgggaagaggcgctcctcacttcctagatgggatggcggccgggcggagacgctcctcactttccagactgggcagccaggcagaggggctcctcacatcccagacgatgggcggccaggcagagacactcctcacttcccatacggggtggcggccaggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaaccccgtctccaccaaaaccagtcaggcgtggcgacgcgtgcctgcaatcgcaggcactcggcaggctgaggcaggagaatcaggcagggaggttgcagtgagccgagatggcagcagtacagtccagcttcggctccgcatgagagggagaccgtggaaagagagggagaccgtggggagagggagcgggggagggggagggggcccctcagaagtttttagaagtcctttccacacccccagctgaggttttctaactggccctgcaccctctagcctcctccaaaatcactaactctccctcctgccccaccattctctcctctgtcccaccctctctggagaaaacacaaattcctctggctttctacggagaaagagaaagcgacattttaaccgtatctctttgttgcttaagttcctgccaacactcatgctttgcagatctgtctacccctaataggcttatttcccctgtaaactaaaaacaaatcctaagccccctaactaattgaatggaccctcttggccaaggagaccccagaaaaaccttaaaaactgagtttccagccatgacaggtcagggggtcagacatgcctggttatactccctcccttttgcagttcagacacaacatctgaccagcatcaatgttaaaatagagatcatagactaacagaatgcactctttatggcaataagataccaaattataatcaggacctaaggccgtgtcaggtaagggttaagtcacacacgcctacacctaaagaataaactatattttctgccaggcacggtggctcacgcctgtaattccaacactttcagaggccgaggggggcagactgcttgagcgcaggagttcgagaccagcctggacaacatagtgagaccctgtctcttaaaaaaaaaaaaaaaaaaaaagaacggcggctcacgcctgtaatcccagcactttgggaggcctaggcaggcagatcacgaggtcaggagatcgagaccatcctggctaacatggtgaaaccccatctctactaaaaatacacaaaaaaattagccagaatatgtatgtttagccaacctgttcagcataaagctcctgtcccagcccctcttcctttcaagtacctgcaacaaaattcaacaacccttcatgctaaaaactctcaataaactaggtattgatgggacgtatctcaaaataataagagctatttatgacaaacccacagccaatatcatactgaatgggcaaaaactggaagcattccctgtgaaaactggcacaagacagggatgccctctctcaccactcctattcaacatagtgttggaagttctggccagggcagtcaggcaagagaaagaagtaaagggtattcaattaggaaaagaggaagtcaaattgtccctgtttgcagatgacatgattgtatatttagaaaaccccatcatctcagcccaaaatctcctcaagctgataagcaagttcagcaaagtctcaagatacaaaattaatgtgcaaaaatcacaagcattcctatacaccaataacagacaaacagagagccaaatcatgagtgaactcccattcacaattgctacaaagagaataaaatacctaggaatacaacttacaagggatgtgaaggacctcttcaaggagaactacaaaccactgctcaatgaaataaaggaggacacaaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggagccaaaaaagcccacatttccaagacaatcctaagccaaaagaacaaagctggaggcatcacactacctgacttcaaactgtactacaaggctacagtaaccaaaacagcatggtactggtaccaaaacagagatatagaccaatgcaacagaacacaggcctcataaataataccacacatctacaaccatcagatctttgacaaatctgacaaaaacaagaaatggggaaaggattccttatttaataaatggtgctgggaaaactggctagcaatatgtagaaagctgaaactggatttcttctttataccttacacaaaaattaattcaagatggattaaagacttaaatgttagacctaaaaccatgaaaaccctagaagaaagcctaggcaataccattcaggacataggcatcggcaaggacttcatgactaaaacaccaaaagcaatggcaacaaaagccaaaagagcttctgcacagcaaaagaaactaccatcagagtgaacaggcaacctacagaatgggagaaaatttttgcaatctatccatctgacaaagggttaatatccagaatctacgaggaacttaaacaaatttacaagaaaaaaacaaccccatcaaaaagtgggcaaaggatatgaatagacacttctcaaaagaagacatttatgcagccaacagacacatgaaaaaatgctcatcatcactggtcatcagagaaatgcaaatcaaaaccacaatgagataccatctcacacgagttagaatgacgatcattaaaaggtcaggaaacaacagatgctggagaggatgtggagaaacaggaacgcttttacactgttggtgggagtgtaaactagttcaacaattgtggaagacagtgtggcgattcctcaaggatctagaactagaaataccatttgacccagtgatcccattactgggtatatacctaaagaattataaatcatgctactgtaaagacacatgcacacgtatgtttattgcagcactattcacaatagcaaagacttggaaccaacccaaatgtccatcaatgatagactggactaagaaaatgtggcacatatacaccatggaatactgtgcagccataaaaaatgatgagttcatgtcctttgcaggcacatggatgaagctggaaaccattattctgagcaaaccatcacacagacagaaaaccaaacaccacatattgtcactcataggtgggaattgaacaatgagaacacttggacacagggcagggaacatcacacaccagggcctgtcatggggtggggggctgggggagggatagcattaggagaaataccttacgtaaatgatgagttaatgggtgcagcaaaccaacttggcacatgtatacctatgtaacaaacctgcacattgtgcatacataccctagaacttaaagtatatatatataaaaaaattagctgggcgtggtggtgagcgcctgtaatcccagccacttgggaggctgaggcaggagagtcgcttgaacccgggaggcagaggttgcagtgagctgagattgcaccactgcactccagccttgatgacagagcgagattgtctcagaaaaaaaaaaaaagagcagtggtttgtagttctccttgaagaggtccttcacatcccttgtaagttgtattcctaggtattttattctctttgtagcaattgtgaatgggagttcactcatgatttggctctctgtttgtctgttattggtgtataggaatgcttgtgatttttgcacattaattttgtatcttgagactttgctgaacttgcttatcagcttaaggagattttgggctgagatgatggggttttctaaatatacaatcatgtcatctgcaaacagggacaatttgacttcctcttttcctaattgaataccctttacttctttctcttgcctgactgccctggccagaacttccaacactatgttgaataggagtggtgagagagggcatccctgtcttgtgccagttttcacagggaatgcttccagtttttgcccattcagtatgatattggctgtgggtttgtcataaatagctcttattattttgagatacgtcccatcaatacctagtttattgagaatttttagcatgaagggttgttgaattttgttgaaggtcttttctgtatctattgagataatcatgtggtttttgtcgttggttctgtttatgtgatggattacgtttcttgatttgtgtatgttgaaccagccttgcatcccagggatgaatccgacttgatcatggtggataagctttttgatgtgctgctggattcggtttgtcagtattttattgaggattttcgcatcaatgttcatcaggcatattggtctaaaattctcttttttgttgttgtgtctctgccaggctttggtatcaggatgatgatggcatcataaaatgagttagggaggattccctctttttctcttgattggaatagtttcagaaggaagggtaccagctcctctttgtacctctcgtagaattcggctgtgaatccatctggtcctggactttttttggttggtaggctattgattattgcctcaatttcagagcctgttattggtctattcagagattcaccatcttcctggtttattcttgggagggtgtatgtgtccaggaatttatccatttcttctagattttctagtttatttgcttagaggtgtttatagtattctctgatggtagtttgtatatctgtgggattggtggtgatatcccctttatcattttttattgcgtctatttgattcttctctcttttcttctttattagtcttgctagcggtctatcaattttgttgatcttttcaaaacaccagctcctggattcattgattttttgaagggtttttcgtgtctctatctccttcggttctgttttgctcttagttatttcttgccttctgctagcttttgaatttgtttgctcttgcttctctagttcttttaattgtgatgttagggtgtcgattttagatctttcctgctttctcttgtgggcatttagtgctataaatttccgtctacacactgctttaaatgtgtcccagagattctggtatgttgtgtctttgttctcattggtttcaaagaacatctttatttctgccttcatttcgttatttacccagtagtcattcaggagcaggttgttcagtttccatgtagttgtgtggttttcactgagtttcttaatcctgagttctaatttgatttcactgtggtctgagagacagtttgttgtggtcttttacatttgctgaggagtgctttacttccaactatgtggtcaattttggaataagtgcaatgtggtgctgagaagaatgtatattctgttgatttgtggtggagagttctgtagatgtctattaggttggcttggtgcagagctgagttcaaatcctggatatccttgttaaccttctgtctcgttgatctgtttaatgttgacagtggggtgttaaaatctcccattactattgtgtgggagtctaagtctctttttaggtctctaaggacttgctttatgaatctgggtgctccagtattgggtgcacaaatatttaggatagttagttcctcttgttgaattgatccctttaccattatgtaatggccttgtctcttttcatcttcgttggtttaaagtctgttttatcagagactaggattgcaacccctgcttttttttgctttccatttgcttggcagatcttcctccatccctttattttgagcctatgtgtgtctgtgcacgtgagatgggtctcctgaatacagcacactgatgggtcttactctttatccaatctgccagtctgtgtcttttaattgggcatttaccccatttacatttaaggttaatattgttatgtgtgaatttgatcctgtcattatgatgttagctggttattttgcccattagttgatgcagtctcttcctagcaacagtggtctttacaatttggcatgtttttgcggtggctgataccggttgttcctttccatgtttagtgcttcctccaggagctcttgtaaggcaggcctggtggtgacaaaatctcagcatttgcttgtctgtaaaggattttatttctctttcacttatgaagcttagtttggctggatatgaaattctgggttgaaaattcttttcttgaagaatgttgaatattggcccccactctcttctggcttgtagagtttctgctgagaaatccactgttagtctgatgggcttccctttgtgggcaacctgacctttctctctggctgcccttaacattttttccttcatttcaaccttggtgaatctgacaattatgtgtcttggggttgctcttctcgaggagtatctttgtagtgttctctgtatttcctgaatttgaatgttggcctgccttgcaaggttggggaagttctcctggataatatcctgaagagtgttttccaacttggcttcattctccccatcactttcaagtacaccaatcaaatgtagatttggtcttttcacatagtcccatatttcttggaggctttgttcatttctttttactcttttttctctaaacttctcttctcactttatttcattaatttgatcttcaatcactgataccctttcttccacttgatcgaatcagctactgaagcttgtgcatgtgtcacgtagttctcatgccatggttttcagctccatcaggtcatttaaggtcttctctacactgtttattctagttagccatttgtctaatcttttttcaaggtttttgtcttccttgcgatgggttcgaacatcctcctttagctcagagaagtttgtcattaccaaccttctgaagcctacttctgtcaactaaagtcattcttcgtccagcttttttccattgctggtgaggagctgcaatcctttggaagagaagaggcactctggtttttagaattttcagcttttctgctctgttttctccccatctttgtggttttatctacctttggtctttgatgttggtgacctatggatggggttttggtgtggatatcatttttgttaatgttgatgctattcctttctgtttgttagttgtccttctaacagtcaggtccctcagctgcaggtctgttggagtttgctggaggtccactccagaccctgtttgcctgggtatcaccagcagaggctgcagaacagcaaatattgcagaacagcaaatattgctgcctgatccttcctctggaagcttcatcccagaggagcacccgcctgtatgaggtgtcagtcgacccctactgggaggtgctcccagttaggctacacaggggtcagggacccacttgaggaggcagtctgtctgttcccagagctcaaatgccatgctgggagaaccactgctcttaagagctgtcagatagggacttttaagtctgcagaagtttctgcctacttttgttcagctatgccctgcccctagaggtagagtcaacagaggcagcaggctttgctgagctgcagtggactccgcccagttcaagcttccctggctgctttgtttacctactcaagcctcagcaatggcagatgcccctcccactgccaggctgctgccaggctgctgcctcgcatgtcaatctcagactgctgtgctagcagtgagcaaggctctgtgggcgtggaaccctccaagccatgcgtggcatataatctcctggtgtgccgtttactaagaccattggaaaagcacagtatttaggcaggagtgtcctgtttttccaggtacagtctgtctcggcttcctttggctaggaaagggaaatcccccaaccccttctgcttcctgtgtgaagtgatgtcctgccctgctttggcttgccctccgtaggctgcacccactgtccaaccagtcccagtgagatgaaccaggtacctcagttggaaatgcagaaatcacccatcttctgcgttgatcaccctgggagctgcagactggaactgttcctattcagccgtgtgctaatttttgtatttttagtagagacgggattttgccatgttggccaggctggtctggaactcctgacctcaagtgatctgtctgcctcagcctcccaaaatgttgggattacaggcgtgagccaccacgcctggccaaatttgtgatttttttttgagatggagtcttgctctgtcacccaggctggagtgcagtggtgtgatctcagctcactgcaagctctgcctcctgagttcacaccattctcctgcctcagcctcccaagcagctgggactacagcccgccaccatgcccggctaattttttgtatttttagtagagacagggtttcactgtgttagccaggatggtctcaatctcctggcctcatgatccacccgcctcgacctcccaaagtgctgggattataggcatgagccatcgtgcctggcccaaatttgtgatttttaagttaacattcctaatagagacagtttggatcacgaggtcaggagattgcaaccaccctggctaacacagtgaaaccctgtctctactaaaaagtacaaaaaattagccagacgtggtggcacatgcctgtaatcccagctactcaggaggctgaagcaggagaatcacttgaacctggaaggtggagtttgcagtgaaccaagatcgtgccattgcactccagcctgggtgacagagcaagactgtctcaaaaaaacaaaaagacaattcctctcctaaaagaaattcaaggagcactgttaagttattctatttttcacttcatttttatattaagaatatatgaaatttaatatatctaataaatacctatctctatatttattatttagaacgcataattctaccttggatagtctgcttgaggaaataatcctaaatacataaaaggctttgtacacaaaaatgctcattcagtattatttaaaccaacaaaaaactggagataacctaattgtccaacaacagagaaatgtttaggtaaatcatgctgtatccttctgatggaatattatgcagccattaaaaatgatatttaaaaagagctggtaatatggtctgagaaaccaaaacacacacccctttatcactaagatagaacctaaggttaaggaaacaaaggttaattatacggttcaacgcagctggcatggcaactccctaaattcctgtggctataggaaaaaccacattctggataaactgtctcaacaacaggaggtatcaggcaaatgatcagacctcgcctagctaatttacaagccagaccactacaactctgattggacagaggactggccttacattcttttctttctttcttttgttttttgagaccgagtttcgctcctgttgcccgggctagagtgcaatggcgcgatctcagctcaccacaacttctgcctccagggttcaagcgattctcctgcctcagcctcctgagtagctgggattacaggcatttgccaccacgcccagctaattttgtatttttagtagagatggggtttctccatgttggtcaggctggtctcaaactcctgacctcaggtgatctgcccgcctcagcctcccaaagtgctgggattacaggtgtgagccaccgcgcccagcccttttctttatttttttaacattttttattttttataattgagatgggagctccccatgttgcccaggcttgtctcgaactcctgagcacaagcaatccacccaccttggcctcccaaagtgctgggattacaggcatgagccactggcctacaaacattctattttgataagcagttgcagaccttaaaccagtttcagccagtttatagaggctccacacaaaccgtctttgtgttctacagttcacctttgatgtaaagagccaaattccacctcattttaatgctgaaacctgccccaaagtgaacatgggatttatgttacatatatgtttgcccattgcacatgtacttggctcccctcataaatatgtatagtttttcccccaaaaccgctaaatatgtatgactattgtgtagtacagaccctgtgaggcttaaaacccaacctgccctttccctctttgaagagaatagagagcaccttcagtccatgtctgagactatctcttcctggtttgcaaactggtatcacttagtaaagctctcctatctactatttaaccatcatggtggtcttttggacaataataaagtggaaaaatgttataatctgatattaagtggaaaaggatatgatgatacgtatggagtgaaatcacactgttttgaaaactaaaaattagcatggaaaaaaactgaaaggagccgggcatggtggcgtgtgcctatagtaccagctactcagtaggctgaggcacaaggatcgcttgaacctgggaggtggaggttgcagtgagctgagattgctctgctgcactccagcctggcgtcagagtgagaccctgtctcaaaaaaaaaaaaaaaattccgggcacagtgactcaacctataatcccagcactttgggaggctgaggagggtggatcacttaacatcaggagttcgagaccagcgtgatcaacatggtgaaacccgtctctactaaaaatacaaaaaaaattagccgggcgtagtggcaggcgcctgtagtcccagctactcaggaggctcaggcaggagaatcgcgtgatcccaggaggtggaggctgcagtgagccaagatcgtgccacttcactccagcctggacaacagagcaagactctctctccaaaataaacaaaaacaaacaaacaaaaaaactgaaaggaaacacacaaaaatgttaccagtaactgtctttggattgtggttctgcaagttattgtttttctatgttttttttctgagcatgctttttttccataatagaaacattgtttattttcttcttcttcttctttttttttttgagatggagtctagctgtgtcgcccagactggagtgcagtggcgtgatctaggcacaatgcaacctccacctcccaggttcaagcgattctcatgcctcagcctcccgagtagctgggattacaggcaccctccaccacactggctaatttttgtatttttagtagagacaggtttcaacatgttggccatgcttgtctggaactcctgacctcaggtgatttactcgccttggcctcccaaagtgctgggattacaggtgtgagccaccttgcctggctattttctaagaacaacaaaaatcttctttatattaagaaaaaacatatatcctctgatgctcttacccaataatcttagttctacccattggaggtaaactaagtcaaaattattttctatgtaagagcttttctgatgtttgacatttgacttcattcccctatatattttctttccttccttccttccttcctcccttccttccttccttcctctctctctccctccctcctttctttcttctccctctttctctctctctctctctctttctttttttttgagacagggtcttgctctgttgcctgggttggagtgcagtggagtgatctcggcaatctctgcttcctgggctgaagcagcaatcttcccacctcagcctccagagtagctggaactacaggcattttcttccagcctcctgtgcagctaggacacagtcacatgaccaaggcacaccaatcagatgtattggaaggtggaaagatgaaccaggaagcacacataattgattcaggtgagtggcagcagcagttccacccaatttccagagacagccagggcagcagttgtaagagcagcatccagcatttggtaagattagccaaggaagcagcagcttctgtacccacaggtggcagctggagtgtgttcacaagaactgttgtgtggcttgatttgggtactgtttctgactacacagcctccaagacagctcactcgacctcccaattatttaaggtactcccttatattctactaataaatttcttttctggaaagtcagttaagtcagcttaaatcagtcagtttccgttacttgaatcacaaacctagactaaaatagcttccttgaatcttcattttgactagatttgccctgggggacagctcagagtgggaaaagttgattcctgccaagcatctacagcccgttccagaccagacagggatttcagctaccaaaacctgctctgatgcctgattattgtgtacctgaacaacttacagtgcagagtgggaaggctggattgcctctgaatttgattctccatagccatttcagcctctagccagcaggtgggggcctcctcagtcttctgaaatcagcctgccaggcatcgccctctccttcccctctgctgcaggaactagagaggcgactcagtaggcaccccttgggccaggtggactcctggcaatagttgctaacacgcctcttgtactccagccccacttccccatccatcctcacatacaagccacagaaaaagagaagacgtgggaccacaaatgctgtgcattccatatggcccctagggtttatgtgtatctgtgaaggcatcagagacaggacacacttttctttgtccagggtgatggaaaggacacaggagttattttctcaccctggaattaaaagactagaaaatacattctccttccacctagaaatgtcccccaaggttgatggcttctcatgccagtcccatcatggctcgcattcaggtgtcagagtgatcttcctttcattatatcactatatcatgcctccactgtcgatccatccctatgtcccaccatagaatatttaaaagcctggaatggaccccatttacaagtgaggaaactgaggctcagaggttggcttgccacctcaaatctaaactctgcgtagcttccaagaatctctataaccaggtctcactccacctttctactcgtgggttctccatagcaaaattgcccttccaatcctgtgagaatatataagaaccatacagtcccttgcatattttttattttattttatttatttattttcttgagacggagtctcactctgtcacccaggctggagtgcagtggtgcgatcttggctcactgcaagctctgcctcctgggttcaccccattctcctgcctcagcctcccgagtagctgggactataggcgcccaccaccacacccggctaatttttttgtatttttagtagagacggggtttcaccgtgttagccaggatggtctcgatctcctgaccttgtgatccgcccgcctcggcctcccaaagtgctaggattgcaggcgtgagccaaccgcgcctggccgccccttgaatattttttaagatagtaattccaagctttatctaagatgaagcattttttagccaatcaattttttaaatttttttattttttggaaacagagtctcactctgtcactcaagctggagtgaagtggcactatcatggctcactacaacctctgcctcctggactcaagcaatcctcccacctcagcctccggagtaattgggaatacaggtgcacaccaccacgcccagtctaatttttttttttttgagacggagtctcactctgttgcccaggctggagtgcagtggcgtgatctcagctcactgcagcctctgcctcccgggttcaagcgattctcctgcctcagcctcctgagtagctgggactacaggcacacgccaccatgcctggctaatttttgtatttttagtagagacggggtttcaccatgttggccaggctagtctcgaactcctgaccttgtgatccacccattttggcctcccaaagtgctgggattacaggtatgagccaccgcgcctggccctacccagcctaattttttttttttttttttttttgagacagagtcttgctctgtcacccaggctggagtgcagtggcgtgatttcggctcactgcaacctctgtctcctgggttcaagcaattcttctgcctcagcctcccgagtagctgggactacaggcacgtgccaccatgcccagctaatttttgtatttttagtagagacggggtttcatcctgttggccaggctggtcttgaactcctgacctcatgatc

SEQ ID NO: 323 - DNA, 1854 bp, Homo sapiens
gcaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcaaaaaaaaaaaaaaaaa

SEQ ID NO: 324 - DNA, 2593 bp, Homo sapiens
agataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcacgaagaagaaatgatgcggcgacacgaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggtctcccaaaatgctgggattacaggggtgagccaccgtgcccaacctcacttgcttcttatccttacactcccccagccccagagaaactgccacatacaccacaaaaaccaaacatgccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaaatcttgtgttaacttgcctccatctttttcttggggtgagggacaccagggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacttttaagcctttt

SEQ ID NO: 325 - DNA, 733 bp, Homo sapiens
gggtgtctttccattcaaataatacctaacactgtacattgtttaatatcatagaaaaacttggttcttccatgaaatcctttaaattcttgataaatttttcaatgtagacattattatgaatgaaaaacagccaacaaatgggcatctgtttttttaacactgaagatttacagacactttttaaaagttatcataatcttttttgtcttttttcccctcagcttcaaatccatcaacttcatcactatctcttcttcgctacctgttgttgtggatgttaaaacgttggctcatttgcggtaatggatccatgcctagaactttgtgtatctggcggaatgcaaggagtctcaatgcaaactgtgcactggatgtgatgtcttcacgctgctggtcagtcattgttgccaaggtatcaaagggatccttttcacaaggatccagaagtccaggactacctttaagaataatccctgaagaaatgcattcaaaaactcttctcagtgcatccccagggctctgagggctagaagcactgctgattgctttctctactagtaactccatagcccagcttggaaaatcagaccaagctgggaactcgctgacagaggtctcgaagaatgcgtatgataatcacacacgactgcagaccattagctctagcctgtaaccacttagcgctgcgtagagcacacagagcgtcaaggcatttttgcctgtccaagac

SEQ ID NO: 326 - DNA, 1968 bp, Homo sapiens
ccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggagaggagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctg

SEQ ID NO: 327 - DNA, 1637 bp, Homo sapiens
ctacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaaaaaaaaaaaaaaaaaaaaaaaaa

SEQ ID NO: 328 - DNA, 313 bp, Homo sapiens
agatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaat

SEQ ID NO: 329 - DNA, 152 bp, Homo sapiens
agcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgt

SEQ ID NO: 330 - DNA, 350 bp, Homo sapiens
acagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaag

SEQ ID NO: 331 - DNA, 398 bp, Homo sapiens
atttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacag

SEQ ID NO: 332 - DNA, 25 bp, Homo sapiens
tttccgtctttttgatgagaacaat

SEQ ID NO: 333 - DNA, 25 bp, Homo sapiens
aagacctacctggagtggcccatgg

SEQ ID NO: 334 - DNA, 25 bp, Homo sapiens
acctacctggagtggcccatggacg

SEQ ID NO: 335 - DNA, 25 bp, Homo sapiens
taaatctgagagctgcgataaagtc

SEQ ID NO: 336 - DNA, 25 bp, Homo sapiens
gataaagtcctaggttcccatattt

SEQ ID NO: 337 - DNA, 25 bp, Homo sapiens
aggttcccatatttaagaccagtct

SEQ ID NO: 338 - DNA, 25 bp, Homo sapiens
ccagtctttgtctagttgggatctt

SEQ ID NO: 339 - DNA, 25 bp, Homo sapiens
tataaaaactacgtggatgtaccgt

SEQ ID NO: 340 - DNA, 25 bp, Homo sapiens
aactacgtggatgtaccgtcatttg

SEQ ID NO: 341 - DNA, 25 bp, Homo sapiens
actacgtggatgtaccgtcatttga

SEQ ID NO: 342 - DNA, 25 bp, Homo sapiens
gtggatgtaccgtcatttgaggact

SEQ ID NO: 343 - DNA, 25 bp, Homo sapiens
tcatttgaggacttgcttactaaaa

SEQ ID NO: 344 - DNA, 25 bp, Homo sapiens
tgaggacttgcttactaaaactaca

SEQ ID NO: 345 - DNA, 25 bp, Homo sapiens
tacaaaacttcaaattttgtctggg

SEQ ID NO: 346 - DNA, 25 bp, Homo sapiens
cttcaaattttgtctggggtgctgt

SEQ ID NO: 347 - DNA, 25 bp, Homo sapiens
atgagataaccatgatcataagtct

SEQ ID NO: 348 - DNA, 25 bp, Homo sapiens
gaagcaaactgttaatcttcgaaaa

SEQ ID NO: 349 - DNA, 25 bp, Homo sapiens
tttcacttcttggatatcaagtgct

SEQ ID NO: 350 - DNA, 25 bp, Homo sapiens
gatatcaagtgctaacccagtatgt

SEQ ID NO: 351 - DNA, 25 bp, Homo sapiens
acagagtcctttctgctggtgagga

SEQ ID NO: 352 - DNA, 25 bp, Homo sapiens
tttctgctggtgaggacagcatttc

SEQ ID NO: 353 - DNA, 25 bp, Homo sapiens
gagcagggctttgttctctatgtgc

SEQ ID NO: 354 - DNA, 25 bp, Homo sapiens
gcccttgttctgtgtgtagttactt

SEQ ID NO: 355 - DNA, 25 bp, Homo sapiens
tgtagttacttgacagcatcaaatg

SEQ ID NO: 356 - DNA, 25 bp, Homo sapiens
ttgacagcatcaaatgccgcctctt

SEQ ID NO: 357 - DNA, 25 bp, Homo sapiens
tgacagcatcaaatgccgcctcttc

SEQ ID NO: 358 - DNA, 25 bp, Homo sapiens
tgtccttcaagttttcatgaactag

SEQ ID NO: 359 - DNA, 25 bp, Homo sapiens
gtccttcaagttttcatgaactagc

SEQ ID NO: 360 - DNA, 25 bp, Homo sapiens
gttctgggcgcctgattttgctgtg

SEQ ID NO: 361 - DNA, 25 bp, Homo sapiens
ttctgggcgcctgattttgctgtga

SEQ ID NO: 362 - DNA, 25 bp, Homo sapiens
gattttgctgtgactcccagaccca

SEQ ID NO: 363 - DNA, 25 bp, Homo sapiens
atctgagagcgtgctgtttgtggct

SEQ ID NO: 364 - DNA, 25 bp, Homo sapiens
acaattctgggcacggtgaagccca

SEQ ID NO: 365 - DNA, 25 bp, Homo sapiens
acggtgaagcccaatgcaaacagaa

SEQ ID NO: 366 - DNA, 25 bp, Homo sapiens
ccacgcttcaatgagaacaacagga

SEQ ID NO: 367 - DNA, 25 bp, Homo sapiens
cacgcttcaatgagaacaacaggag

SEQ ID NO: 368 - DNA, 25 bp, Homo sapiens
cgcttcaatgagaacaacaggagag

SEQ ID NO: 369 - DNA, 25 bp, Homo sapiens
gacagtcggttttcccatttgaaag

SEQ ID NO: 370 - DNA, 25 bp, Homo sapiens
gaaatcagcaaactgggaatttctg

SEQ ID NO: 371 - DNA, 25 bp, Homo sapiens
cagcaaactgggaatttctggtgac

SEQ ID NO: 372 - DNA, 25 bp, Homo sapiens
caaactgggaatttctggtgacata

SEQ ID NO: 373 - DNA, 25 bp, Homo sapiens
ggaatttctggtgacatagacctca

SEQ ID NO: 374 - DNA, 25 bp, Homo sapiens
gaatttctggtgacatagacctcac

SEQ ID NO: 375 - DNA, 25 bp, Homo sapiens
tgacatagacctcaccagtgcttca

SEQ ID NO: 376 - DNA, 25 bp, Homo sapiens
gacatagacctcaccagtgcttcat

SEQ ID NO: 377 - DNA, 25 bp, Homo sapiens
gaatctaaaccttacatgtgtaaag

SEQ ID NO: 378 - DNA, 25 bp, Homo sapiens
atctaaaccttacatgtgtaaaggt

SEQ ID NO: 379 - DNA, 25 bp, Homo sapiens
accttacatgtgtaaaggtttcatg

SEQ ID NO: 380 - DNA, 25 bp, Homo sapiens
gcagtatgccacttcttaaaacaga

SEQ ID NO: 381 - DNA, 25 bp, Homo sapiens
attgtgctcttttctaatccaaagg

SEQ ID NO: 382 - DNA, 25 bp, Homo sapiens
taatccaaagggtatatttgcagca

SEQ ID NO: 383 - DNA, 25 bp, Homo sapiens
ggtatatttgcagcatgcttgactt

SEQ ID NO: 384 - DNA, 25 bp, Homo sapiens
gcttgactttaccaattctgatgac

SEQ ID NO: 385 - DNA, 25 bp, Homo sapiens
accaattctgatgacatctttacgg

SEQ ID NO: 386 - DNA, 25 bp, Homo sapiens
gatgacatctttacggacactatta

SEQ ID NO: 387 - DNA, 25 bp, Homo sapiens
ggacactattatcactaagaccttg

SEQ ID NO: 388 - DNA, 25 bp, Homo sapiens
cgaagtctttagtctttttcatgta

SEQ ID NO: 389 - DNA, 25 bp, Homo sapiens
tctctttatgtagtttgactatgcc

SEQ ID NO: 390 - DNA, 25 bp, Homo sapiens
gtagtttgactatgccttacctttg

SEQ ID NO: 391 - DNA, 25 bp, Homo sapiens
aattcttcagggagtgtcacctcaa

SEQ ID NO: 392 - DNA, 25 bp, Homo sapiens
ctcaaatgcaatactttgggttggt

SEQ ID NO: 393 - DNA, 25 bp, Homo sapiens
tgtgagcatgggtacccatttgata

SEQ ID NO: 394 - DNA, 25 bp, Homo sapiens
gtacccatttgataagagaaatgca

SEQ ID NO: 395 - DNA, 25 bp, Homo sapiens
agagttaaattctccattatgttcg

SEQ ID NO: 396 - DNA, 25 bp, Homo sapiens
tgcgggtgctgtctgtctccccccc

SEQ ID NO: 397 - DNA, 25 bp, Homo sapiens
ggtgctgtctgtctccccccctttc

SEQ ID NO: 398 - DNA, 25 bp, Homo sapiens
gtgctgtctgtctccccccctttcc

SEQ ID NO: 399 - DNA, 25 bp, Homo sapiens
cttccctccctgtagttttgaagcg

SEQ ID NO: 400 - DNA, 25 bp, Homo sapiens
ccctccctgtagttttgaagcggat

SEQ ID NO: 401 - DNA, 25 bp, Homo sapiens
agttttgaagcggatgtttgttctt

SEQ ID NO: 402 - DNA, 25 bp, Homo sapiens
ttttgaagcggatgtttgttcttta

SEQ ID NO: 403 - DNA, 25 bp, Homo sapiens
aagcggatgtttgttctttatagat

SEQ ID NO: 404 - DNA, 25 bp, Homo sapiens
cggatgtttgttctttatagatgtt

SEQ ID NO: 405 - DNA, 25 bp, Homo sapiens
ttctttatagatgttgtttaaaaag

SEQ ID NO: 406 - DNA, 25 bp, Homo sapiens
gtttaaaaagcctgataatggtgat

SEQ ID NO: 407 - DNA, 25 bp, Homo sapiens
tttaaaaagcctgataatggtgatt

SEQ ID NO: 408 - DNA, 25 bp, Homo sapiens
aaaaagcctgataatggtgattgaa

SEQ ID NO: 409 - DNA, 25 bp, Homo sapiens
aagcctgataatggtgattgaaatt

SEQ ID NO: 410 - DNA, 25 bp, Homo sapiens
agcctgataatggtgattgaaattt

SEQ ID NO: 411 - DNA, 25 bp, Homo sapiens
caatgtgctttcctaaccgtgcccc

SEQ ID NO: 412 - DNA, 25 bp, Homo sapiens
tgcggtttgtggacaacatgtacaa

SEQ ID NO: 413 - DNA, 25 bp, Homo sapiens
attgaagatgtcctaagcccagata

SEQ ID NO: 414 - DNA, 25 bp, Homo sapiens
cctaagcccagatacctgtgtatgt

SEQ ID NO: 415 - DNA, 25 bp, Homo sapiens
cccagatacctgtgtatgtcggaca

SEQ ID NO: 416 - DNA, 25 bp, Homo sapiens
tgtcggacagatgaaggccgagtcc

SEQ ID NO: 417 - DNA, 25 bp, Homo sapiens
atgaaggccgagtcctggaaggcct

SEQ ID NO: 418 - DNA, 25 bp, Homo sapiens
tcctggaaggcctgagggaagacat

SEQ ID NO: 419 - DNA, 25 bp, Homo sapiens
gaagacatgctggagaccctggttc

SEQ ID NO: 420 - DNA, 25 bp, Homo sapiens
aagacatgctggagaccctggttcc

SEQ ID NO: 421 - DNA, 25 bp, Homo sapiens
gacatgctggagaccctggttccca

SEQ ID NO: 422 - DNA, 25 bp, Homo sapiens
ttcccaaggcagagggtgaccgtgt

SEQ ID NO: 423 - DNA, 25 bp, Homo sapiens
gagccgggctttggtgcaactgcca

SEQ ID NO: 424 - DNA, 25 bp, Homo sapiens
actgccaagagaaaatcaggtggtg

SEQ ID NO: 425 - DNA, 25 bp, Homo sapiens
catcctctacttctggtgcagtcct

SEQ ID NO: 426 - DNA, 25 bp, Homo sapiens
atcctctacttctggtgcagtcctg

SEQ ID NO: 427 - DNA, 25 bp, Homo sapiens
tacttctggtgcagtcctgggacaa

SEQ ID NO: 428 - DNA, 25 bp, Homo sapiens
ctgatttattctgttactagatcag

SEQ ID NO: 429 - DNA, 25 bp, Homo sapiens
agatcaggttttagggtcctgcaaa

SEQ ID NO: 430 - DNA, 25 bp, Homo sapiens
agggtcctgcaaaaggctagctcgg

SEQ ID NO: 431 - DNA, 25 bp, Homo sapiens
ctgcaaaaggctagctcggcactac

SEQ ID NO: 432 - DNA, 25 bp, Homo sapiens
agctcggcactacactagggaattt

SEQ ID NO: 433 - DNA, 25 bp, Homo sapiens
ggaatttgctcctgttctgtcactt

SEQ ID NO: 434 - DNA, 25 bp, Homo sapiens
tgaggcttttagttccctggcccgg

SEQ ID NO: 435 - DNA, 25 bp, Homo sapiens
acatcttgctcaagtcaggaggccg

SEQ ID NO: 436 - DNA, 25 bp, Homo sapiens
gctcaagtcaggaggccggagatca

SEQ ID NO: 437 - DNA, 25 bp, Homo sapiens
caagcctcccagtactgacctgaaa

SEQ ID NO: 438 - DNA, 25 bp, Homo sapiens
tactgacctgaaaacttgtgacaag

SEQ ID NO: 439 - DNA, 25 bp, Homo sapiens
caccaacaagtgctccctgggctga

SEQ ID NO: 440 - DNA, 25 bp, Homo sapiens
ctccctgggctgaggaccctttctt

SEQ ID NO: 441 - DNA, 25 bp, Homo sapiens
cctgggctgaggaccctttcttgcc

SEQ ID NO: 442 - DNA, 25 bp, Homo sapiens
accccggaagctgaacctgagggag

SEQ ID NO: 443 - DNA, 25 bp, Homo sapiens
tgaacctgagggagacaacggcaga

SEQ ID NO: 444 - DNA, 25 bp, Homo sapiens
acaggcagccacctggacacaaaca

SEQ ID NO: 445 - DNA, 25 bp, Homo sapiens
agactccacagcagaactcccaggg

SEQ ID NO: 446 - DNA, 25 bp, Homo sapiens
gactccacagcagaactcccaggga

SEQ ID NO: 447 - DNA, 25 bp, Homo sapiens
ggcatggcttcagagcaccaggcag

SEQ ID NO: 448 - DNA, 25 bp, Homo sapiens
cttggcctcgggaaatgtagctgga

SEQ ID NO: 449 - DNA, 25 bp, Homo sapiens
tgtagctggagtcatcatttagcag

SEQ ID NO: 450 - DNA, 25 bp, Homo sapiens
tggagtcatcatttagcagagcacg

SEQ ID NO: 451 - DNA, 25 bp, Homo sapiens
catcatttagcagagcacggtgtcc

SEQ ID NO: 452 - DNA, 25 bp, Homo sapiens
tggacagaggcctccggtcagcctc

SEQ ID NO: 453 - DNA, 25 bp, Homo sapiens
ctctcactggacagcatcacctgga

SEQ ID NO: 454 - DNA, 25 bp, Homo sapiens
cactggacagcatcacctggacaca

SEQ ID NO: 455 - DNA, 25 bp, Homo sapiens
acagcatcacctggacacagagcct

SEQ ID NO: 456 - DNA, 25 bp, Homo sapiens
ggacacagagcctcacctagtctgt

SEQ ID NO: 457 - DNA, 25 bp, Homo sapiens
tttgctttggacagtgacaccaaga

SEQ ID NO: 458 - DNA, 25 bp, Homo sapiens
ttggacagtgacaccaagaatactc

SEQ ID NO: 459 - DNA, 25 bp, Homo sapiens
gacagtgacaccaagaatactcacc

SEQ ID NO: 460 - DNA, 25 bp, Homo sapiens
tcatgcacgccctgaagatgacctg

SEQ ID NO: 461 - DNA, 25 bp, Homo sapiens
cctgaagatgacctggcacgtgcac

SEQ ID NO: 462 - DNA, 25 bp, Homo sapiens
gatgacctggcacgtgcactgcttt

SEQ ID NO: 463 - DNA, 25 bp, Homo sapiens
cactgctttacctgtgctgcctgca

SEQ ID NO: 464 - DNA, 25 bp, Homo sapiens
tgcaagacgcccatccggaacaggg

SEQ ID NO: 465 - DNA, 25 bp, Homo sapiens
gcaagacgcccatccggaacagggc

SEQ ID NO: 466 - DNA, 25 bp, Homo sapiens
cggaacagggccttctacatggagg

SEQ ID NO: 467 - DNA, 25 bp, Homo sapiens
ggaacagggccttctacatggagga

SEQ ID NO: 468 - DNA, 25 bp, Homo sapiens
gaacagggccttctacatggaggag

SEQ ID NO: 469 - DNA, 25 bp, Homo sapiens
aagatgtttggcacgaaatgccatg

SEQ ID NO: 470 - DNA, 25 bp, Homo sapiens
gtttggcacgaaatgccatggctgt

SEQ ID NO: 471 - DNA, 25 bp, Homo sapiens
gcacgaaatgccatggctgtgactt

SEQ ID NO: 472 - DNA, 25 bp, Homo sapiens
cacgaaatgccatggctgtgacttc

SEQ ID NO: 473 - DNA, 25 bp, Homo sapiens
tgacttcaagatcgacgctggggac

SEQ ID NO: 474 - DNA, 25 bp, Homo sapiens
acttcaagatcgacgctggggaccg

SEQ ID NO: 475 - DNA, 25 bp, Homo sapiens
tcgacgctggggaccgcttcctgga

SEQ ID NO: 476 - DNA, 25 bp, Homo sapiens
cattcattcggagaaaacgttttga

SEQ ID NO: 477 - DNA, 25 bp, Homo sapiens
tcgtttcaaaagagcacctgagtca

SEQ ID NO: 478 - DNA, 25 bp, Homo sapiens
cacctgagtcatgtgtattcccggc

SEQ ID NO: 479 - DNA, 25 bp, Homo sapiens
tgacccggtcaagttggtttcaaag

SEQ ID NO: 480 - DNA, 25 bp, Homo sapiens
cgacaggcttgtctgtttactagct

SEQ ID NO: 481 - DNA, 25 bp, Homo sapiens
tcctgtgatgaaactgaggaatcgg

SEQ ID NO: 482 - DNA, 25 bp, Homo sapiens
attcccagtatacataagcacagga

SEQ ID NO: 483 - DNA, 25 bp, Homo sapiens
ttctcaagagggatgtatttatcac

SEQ ID NO: 484 - DNA, 25 bp, Homo sapiens
gtatttatcacttggacatctgttt

SEQ ID NO: 485 - DNA, 25 bp, Homo sapiens
ctgccaaaagaatcctaggcagtgg

SEQ ID NO: 486 - DNA, 25 bp, Homo sapiens
tcattgtatgtgaggttgaaccacg

SEQ ID NO: 487 - DNA, 25 bp, Homo sapiens
gaaattgccaatattaggctggctt

SEQ ID NO: 488 - DNA, 25 bp, Homo sapiens
ctggcttttatctacaaagaaggag

SEQ ID NO: 489 - DNA, 25 bp, Homo sapiens
agtttcatggggttcagcctaacag

SEQ ID NO: 490 - DNA, 25 bp, Homo sapiens
accattggcatggtaataaacagat

SEQ ID NO: 491 - DNA, 25 bp, Homo sapiens
tgtaattgggcctttactctctcaa

SEQ ID NO: 492 - DNA, 25 bp, Homo sapiens
tgtccactgagaacgtgggcagtgt

SEQ ID NO: 493 - DNA, 25 bp, Homo sapiens
gagaacgtgggcagtgtccaaattc

SEQ ID NO: 494 - DNA, 25 bp, Homo sapiens
tcctgtactgtaaagactaaaaggc

SEQ ID NO: 495 - DNA, 25 bp, Homo sapiens
gactaaaaggcgtttgctctgagac

SEQ ID NO: 496 - DNA, 25 bp, Homo sapiens
aggcgtttgctctgagactgacaag

SEQ ID NO: 497 - DNA, 25 bp, Homo sapiens
cttcaccatggtactgtctccacag

SEQ ID NO: 498 - DNA, 25 bp, Homo sapiens
tggtactgtctccacagccctcagt

SEQ ID NO: 499 - DNA, 25 bp, Homo sapiens
aaatgaaactgcaaacctcgtgtgt

SEQ ID NO: 500 - DNA, 25 bp, Homo sapiens
gcaaacctcgtgtgtcttaactccc

SEQ ID NO: 501 - DNA, 25 bp, Homo sapiens
cgccccgtggtctggtgcgtgacaa

SEQ ID NO: 502 - DNA, 25 bp, Homo sapiens
tccaaagcgccgagacgagggtgct

SEQ ID NO: 503 - DNA, 25 bp, Homo sapiens
ccgagacgagggtgctgtgtccctc

SEQ ID NO: 504 - DNA, 25 bp, Homo sapiens
tgtgtccctcaaacccagagtggtg

SEQ ID NO: 505 - DNA, 25 bp, Homo sapiens
gtgggcgcctctgaaaccatacagc

SEQ ID NO: 506 - DNA, 25 bp, Homo sapiens
tctgaaaccatacagccactcctgg

SEQ ID NO: 507 - DNA, 25 bp, Homo sapiens
tttagagatctctctaataaatcgg

SEQ ID NO: 508 - DNA, 25 bp, Homo sapiens
atgccactgctcgagccttcaagat

SEQ ID NO: 509 - DNA, 25 bp, Homo sapiens
agaagtacattactgcccatggact

SEQ ID NO: 510 - DNA, 25 bp, Homo sapiens
gaagtacattactgcccatggactg

SEQ ID NO: 511 - DNA, 25 bp, Homo sapiens
aagagatgtctagtcctcagaaact

SEQ ID NO: 512 - DNA, 25 bp, Homo sapiens
gatgtctagtcctcagaaacttctt

SEQ ID NO: 513 - DNA, 25 bp, Homo sapiens
gaaacttctttcctgccctgattgg

SEQ ID NO: 514 - DNA, 25 bp, Homo sapiens
cctgattggggctcttgctgttccg

SEQ ID NO: 515 - DNA, 25 bp, Homo sapiens
ttgctgttccgtttcttctccctgc

SEQ ID NO: 516 - DNA, 25 bp, Homo sapiens
cctagttcttacaggtttcgttgtg

SEQ ID NO: 517 - DNA, 25 bp, Homo sapiens
ctagttcttacaggtttcgttgtgt

SEQ ID NO: 518 - DNA, 25 bp, Homo sapiens
ttgtgcgcgatggtgagtcctgtta

SEQ ID NO: 519 - DNA, 25 bp, Homo sapiens
ttacaagtcgaggacgccgcgaatt

SEQ ID NO: 520 - DNA, 25 bp, Homo sapiens
aggacgccgcgaatttagtagaggt

SEQ ID NO: 521 - DNA, 25 bp, Homo sapiens
gaccctgttacagacataccctatg

SEQ ID NO: 522 - DNA, 25 bp, Homo sapiens
agacataccctatgccactgctcga

SEQ ID NO: 523 - DNA, 25 bp, Homo sapiens
ctatgccactgctcgagccttcaag

SEQ ID NO: 524 - DNA, 25 bp, Homo sapiens
atgcgcaacaacctctcgctggggg

SEQ ID NO: 525 - DNA, 25 bp, Homo sapiens
ccgaagctctgcgcatgcgcgcacc

SEQ ID NO: 526 - DNA, 25 bp, Homo sapiens
ccccgcggacccagcatccccgcag

SEQ ID NO: 527 - DNA, 25 bp, Homo sapiens
ccgcggacccagcatccccgcagca

SEQ ID NO: 528 - DNA, 25 bp, Homo sapiens
cctgctcccgaggcccggcccgtga

SEQ ID NO: 529 - DNA, 25 bp, Homo sapiens
ggaaccctgcctgagacgcctccat

SEQ ID NO: 530 - DNA, 25 bp, Homo sapiens
gagacgcctccattaccactgcgca

SEQ ID NO: 531 - DNA, 25 bp, Homo sapiens
acgcctccattaccactgcgcagtg

SEQ ID NO: 532 - DNA, 25 bp, Homo sapiens
ccactgcgcagtgagatgaggggac

SEQ ID NO: 533 - DNA, 25 bp, Homo sapiens
aggggactcacagttgccaagaggg

SEQ ID NO: 534 - DNA, 25 bp, Homo sapiens
actcacagttgccaagaggggtctt

SEQ ID NO: 535 - DNA, 25 bp, Homo sapiens
cctcccctgggccgctgaggccccg

SEQ ID NO: 536 - DNA, 25 bp, Homo sapiens
gtgctgcccgagcacctcccccgcc

SEQ ID NO: 537 - DNA, 25 bp, Homo sapiens
gaactttgcagctgcccttccctcc

SEQ ID NO: 538 - DNA, 25 bp, Homo sapiens
tttgcagctgcccttccctccccgt

SEQ ID NO: 539 - DNA, 25 bp, Homo sapiens
agaattatttattttcgccaaagca

SEQ ID NO: 540 - DNA, 25 bp, Homo sapiens
ctgcattccttttgcacttttggat

SEQ ID NO: 541 - DNA, 25 bp, Homo sapiens
gcattccttttgcacttttggattc

SEQ ID NO: 542 - DNA, 25 bp, Homo sapiens
tatatgcctgcctttggtacttaat

SEQ ID NO: 543 - DNA, 25 bp, Homo sapiens
atgcctgcctttggtacttaatttt

SEQ ID NO: 544 - DNA, 25 bp, Homo sapiens
aatatatgctatagggacgttccat

SEQ ID NO: 545 - DNA, 25 bp, Homo sapiens
gctatagggacgttccatgcccagg

SEQ ID NO: 546 - DNA, 25 bp, Homo sapiens
tatagggacgttccatgcccaggtt

SEQ ID NO: 547 - DNA, 25 bp, Homo sapiens
cgttccatgcccaggttaacaaaga

SEQ ID NO: 548 - DNA, 25 bp, Homo sapiens
ttccatgcccaggttaacaaagaac

SEQ ID NO: 549 - DNA, 25 bp, Homo sapiens
ccatgcccaggttaacaaagaactg

SEQ ID NO: 550 - DNA, 25 bp, Homo sapiens
catgcccaggttaacaaagaactgt

SEQ ID NO: 551 - DNA, 25 bp, Homo sapiens
atgcccaggttaacaaagaactgtg

SEQ ID NO: 552 - DNA, 25 bp, Homo sapiens
tctcttctgtattgtaacttagatg

SEQ ID NO: 553 - DNA, 25 bp, Homo sapiens
ctcttctgtattgtaacttagatga

SEQ ID NO: 554 - DNA, 25 bp, Homo sapiens
taacttagatgattcccaaggactc

SEQ ID NO: 555 - DNA, 25 bp, Homo sapiens
agatgattcccaaggactctaataa

SEQ ID NO: 556 - DNA, 25 bp, Homo sapiens
atgcttctaatgcttgcatttacaa

SEQ ID NO: 557 - DNA, 25 bp, Homo sapiens
acaatgccgatgacatagtcggaat

SEQ ID NO: 558 - DNA, 25 bp, Homo sapiens
tggaagcgtcatccatgccatcagc

SEQ ID NO: 559 - DNA, 25 bp, Homo sapiens
tatatggtatttctgatcccaacat

SEQ ID NO: 560 - DNA, 25 bp, Homo sapiens
ctgatcccaacatgctgtctaattg

SEQ ID NO: 561 - DNA, 25 bp, Homo sapiens
ctaattgttctgtgaatatgatgac

SEQ ID NO: 562 - DNA, 25 bp, Homo sapiens
caaccagcagtgacagcatgggaga

SEQ ID NO: 563 - DNA, 25 bp, Homo sapiens
ataatccaagacttctgagcatgaa

SEQ ID NO: 564 - DNA, 25 bp, Homo sapiens
acttgagacagctccatcagatgtc

SEQ ID NO: 565 - DNA, 25 bp, Homo sapiens
gacagctccatcagatgtcctcttc

SEQ ID NO: 566 - DNA, 25 bp, Homo sapiens
tccatcagatgtcctcttccagtat

SEQ ID NO: 567 - DNA, 25 bp, Homo sapiens
ccagtatgtcagcaggcgccaattc

SEQ ID NO: 568 - DNA, 25 bp, Homo sapiens
tttcacaatcagatgcatttgaggg

SEQ ID NO: 569 - DNA, 25 bp, Homo sapiens
ttgagggatctgacttcagttgtgc

SEQ ID NO: 570 - DNA, 25 bp, Homo sapiens
acttcagttgtgcagataacagcat

SEQ ID NO: 571 - DNA, 25 bp, Homo sapiens
agtattcaggtattggcagtatgca

SEQ ID NO: 572 - DNA, 25 bp, Homo sapiens
cctgaggaacaactggggcagcccc

SEQ ID NO: 573 - DNA, 25 bp, Homo sapiens
cttccccagagatggctccttggga

SEQ ID NO: 574 - DNA, 25 bp, Homo sapiens
ccagagatggctccttgggatgaag

SEQ ID NO: 575 - DNA, 25 bp, Homo sapiens
aggatcggcttcctcaggggcacag

SEQ ID NO: 576 - DNA, 25 bp, Homo sapiens
aacttccccttagagtgctgtgaga

SEQ ID NO: 577 - DNA, 25 bp, Homo sapiens
tccccttagagtgctgtgagatgag

SEQ ID NO: 578 - DNA, 25 bp, Homo sapiens
tcaccctgtgtaacaggaccccaag

SEQ ID NO: 579 - DNA, 25 bp, Homo sapiens
tcatctgaccttagtttgctgccat

SEQ ID NO: 580 - DNA, 25 bp, Homo sapiens
catctgaccttagtttgctgccatc

SEQ ID NO: 581 - DNA, 25 bp, Homo sapiens
accttagtttgctgccatcagtcta

SEQ ID NO: 582 - DNA, 25 bp, Homo sapiens
tagtttgctgccatcagtctagtgg

SEQ ID NO: 583 - DNA, 25 bp, Homo sapiens
agtttgctgccatcagtctagtggt

SEQ ID NO: 584 - DNA, 25 bp, Homo sapiens
ttgctgccatcagtctagtggtttc

SEQ ID NO: 585 - DNA, 25 bp, Homo sapiens
ctgccatcagtctagtggtttcgtg

SEQ ID NO: 586 - DNA, 25 bp, Homo sapiens
tcagtctagtggtttcgtggtttcg

SEQ ID NO: 587 - DNA, 25 bp, Homo sapiens
gtctagtggtttcgtggtttcgtct

SEQ ID NO: 588 - DNA, 25 bp, Homo sapiens
aggccaaggctatgaagggacagct

SEQ ID NO: 589 - DNA, 25 bp, Homo sapiens
atatttttgctaggagccccagctt

SEQ ID NO: 590 - DNA, 25 bp, Homo sapiens
tatttttgctaggagccccagcttc

SEQ ID NO: 591 - DNA, 25 bp, Homo sapiens
atttttgctaggagccccagcttcc

SEQ ID NO: 592 - DNA, 25 bp, Homo sapiens
gctaggagccccagcttcctgtgtt

SEQ ID NO: 593 - DNA, 25 bp, Homo sapiens
ctaggagccccagcttcctgtgttt

SEQ ID NO: 594 - DNA, 25 bp, Homo sapiens
taggagccccagcttcctgtgtttt

SEQ ID NO: 595 - DNA, 25 bp, Homo sapiens
aggagccccagcttcctgtgttttt

SEQ ID NO: 596 - DNA, 25 bp, Homo sapiens
ggagccccagcttcctgtgttttta

SEQ ID NO: 597 - DNA, 25 bp, Homo sapiens
taaatagtgtacacagactgacgaa

SEQ ID NO: 598 - DNA, 25 bp, Homo sapiens
aatagtgtacacagactgacgaaac

SEQ ID NO: 599 - DNA, 25 bp, Homo sapiens
atagtgtacacagactgacgaaact

SEQ ID NO: 600 - DNA, 25 bp, Homo sapiens
tagtgtacacagactgacgaaactt

SEQ ID NO: 601 - DNA, 25 bp, Homo sapiens
gtgtacacagactgacgaaacttta

SEQ ID NO: 602 - DNA, 25 bp, Homo sapiens
tgtacacagactgacgaaactttaa

SEQ ID NO: 603 - DNA, 25 bp, Homo sapiens
gtacacagactgacgaaactttaaa

SEQ ID NO: 604 - DNA, 25 bp, Homo sapiens
tgtgatgtcccaacttgtaaaaatt

SEQ ID NO: 605 - DNA, 25 bp, Homo sapiens
tatggtactatgttagccccataat

SEQ ID NO: 606 - DNA, 25 bp, Homo sapiens
tggtactatgttagccccataattt

SEQ ID NO: 607 - DNA, 25 bp, Homo sapiens
actccagattttttacagctgcctg

SEQ ID NO: 608 - DNA, 25 bp, Homo sapiens
ccagattttttacagctgcctgcag

SEQ ID NO: 609 - DNA, 25 bp, Homo sapiens
ttacagctgcctgcagtactttacc

SEQ ID NO: 610 - DNA, 25 bp, Homo sapiens
gcagtactttacctcctatcagaag

SEQ ID NO: 611 - DNA, 25 bp, Homo sapiens
tctcagctcccaaggctctgagcaa

SEQ ID NO: 612 - DNA, 25 bp, Homo sapiens
aggctctgagcaaatgtggctcctg

SEQ ID NO: 613 - DNA, 25 bp, Homo sapiens
ctctgagcaaatgtggctcctgggg

SEQ ID NO: 614 - DNA, 25 bp, Homo sapiens
ggaaacatgactcgtatatgtctca

SEQ ID NO: 615 - DNA, 25 bp, Homo sapiens
atgactcgtatatgtctcaggtccc

SEQ ID NO: 616 - DNA, 25 bp, Homo sapiens
atatgtctcaggtccctgcagggcc

SEQ ID NO: 617 - DNA, 25 bp, Homo sapiens
aagcacctagcctcgctcttggcag

SEQ ID NO: 618 - DNA, 25 bp, Homo sapiens
gtatatgttgggtgcaaagttccct

SEQ ID NO: 619 - DNA, 25 bp, Homo sapiens
tatatgttgggtgcaaagttcccta

SEQ ID NO: 620 - DNA, 25 bp, Homo sapiens
acttgtgggactcacctgactcaaa

SEQ ID NO: 621 - DNA, 25 bp, Homo sapiens
cttgtgggactcacctgactcaaag

SEQ ID NO: 622 - DNA, 25 bp, Homo sapiens
ttgtgggactcacctgactcaaaga

SEQ ID NO: 623 - DNA, 25 bp, Homo sapiens
tgtgggactcacctgactcaaagat

SEQ ID NO: 624 - DNA, 25 bp, Homo sapiens
gtgggactcacctgactcaaagatg

SEQ ID NO: 625 - DNA, 25 bp, Homo sapiens
tgggactcacctgactcaaagatga

SEQ ID NO: 626 - DNA, 25 bp, Homo sapiens
gggactcacctgactcaaagatgac

SEQ ID NO: 627 - DNA, 25 bp, Homo sapiens
gactcacctgactcaaagatgacta

SEQ ID NO: 628 - DNA, 25 bp, Homo sapiens
cctgactcaaagatgactaatatcg

SEQ ID NO: 629 - DNA, 25 bp, Homo sapiens
ctgactcaaagatgactaatatcgt

SEQ ID NO: 630 - DNA, 25 bp, Homo sapiens
agatgactaatatcgtcccattttg

SEQ ID NO: 631 - DNA, 25 bp, Homo sapiens
gatgactaatatcgtcccattttgg

SEQ ID NO: 632 - DNA, 25 bp, Homo sapiens
atgactaatatcgtcccattttgga

SEQ ID NO: 633 - DNA, 25 bp, Homo sapiens
tgactaatatcgtcccattttggaa

SEQ ID NO: 634 - DNA, 25 bp, Homo sapiens
atatcgtcccattttggaaataaag

SEQ ID NO: 635 - DNA, 25 bp, Homo sapiens
atcgtcccattttggaaataaagca

SEQ ID NO: 636 - DNA, 25 bp, Homo sapiens
catgcattaacttgcggtatttttc

SEQ ID NO: 637 - DNA, 25 bp, Homo sapiens
agcatcacaagcttttgagcgcatg

SEQ ID NO: 638 - DNA, 25 bp, Homo sapiens
gcgcatggaactccataaactaaca

SEQ ID NO: 639 - DNA, 25 bp, Homo sapiens
tatgtgcacccgtccaggacagaac

SEQ ID NO: 640 - DNA, 25 bp, Homo sapiens
atgtgcacccgtccaggacagaacc

SEQ ID NO: 641 - DNA, 25 bp, Homo sapiens
acccgtccaggacagaaccgtgcat

SEQ ID NO: 642 - DNA, 25 bp, Homo sapiens
tggagcacagcgtccggcccagtgt

SEQ ID NO: 643 - DNA, 25 bp, Homo sapiens
caagtctacgggtgccagatcagta

SEQ ID NO: 644 - DNA, 25 bp, Homo sapiens
tacgggtgccagatcagtagggcct

SEQ ID NO: 645 - DNA, 25 bp, Homo sapiens
tgccagatcagtagggcctgtgatt

SEQ ID NO: 646 - DNA, 25 bp, Homo sapiens
atcagtagggcctgtgatttcctgt

SEQ ID NO: 647 - DNA, 25 bp, Homo sapiens
tgtgatttcctgtcagtgtcctcag

SEQ ID NO: 648 - DNA, 25 bp, Homo sapiens
tcagtgtcctcagctaatgtgaaca

SEQ ID NO: 649 - DNA, 25 bp, Homo sapiens
tcctcagctaatgtgaacagtgttg

SEQ ID NO: 650 - DNA, 25 bp, Homo sapiens
cagtgttggtctgctggttagaaac

SEQ ID NO: 651 - DNA, 25 bp, Homo sapiens
gaaagaaatcagctcagctctccac

SEQ ID NO: 652 - DNA, 25 bp, Homo sapiens
cctctctttattccatgattaaggg

SEQ ID NO: 653 - DNA, 25 bp, Homo sapiens
aagatgactaacgtgtcacggggaa

SEQ ID NO: 654 - DNA, 25 bp, Homo sapiens
agatgactaacgtgtcacggggaag

SEQ ID NO: 655 - DNA, 25 bp, Homo sapiens
cgtgtcacggggaagagctccctgc

SEQ ID NO: 656 - DNA, 25 bp, Homo sapiens
cctttagctgcatttgtatgccagt

SEQ ID NO: 657 - DNA, 25 bp, Homo sapiens
tgccagtgcttaacacattgcctta

SEQ ID NO: 658 - DNA, 25 bp, Homo sapiens
gccagtgcttaacacattgccttat

SEQ ID NO: 659 - DNA, 25 bp, Homo sapiens
gaccaacacatacacgtcatagaag

SEQ ID NO: 660 - DNA, 25 bp, Homo sapiens
ggtgcttctttctgatctctagtgg

SEQ ID NO: 661 - DNA, 25 bp, Homo sapiens
gatctctagtggagatctctttgac

SEQ ID NO: 662 - DNA, 25 bp, Homo sapiens
aagtttaatgcctggccattttcca

SEQ ID NO: 663 - DNA, 25 bp, Homo sapiens
agaggctagagtgcttttagccttt

SEQ ID NO: 664 - DNA, 25 bp, Homo sapiens
gctagagtgcttttagcctttttta

SEQ ID NO: 665 - DNA, 25 bp, Homo sapiens
gtaaccatgatactttaatcagaag

SEQ ID NO: 666 - DNA, 25 bp, Homo sapiens
cttagccttgaaattgtgaactctt

SEQ ID NO: 667 - DNA, 25 bp, Homo sapiens
gaagttcgcaactaaactaaacctg

SEQ ID NO: 668 - DNA, 25 bp, Homo sapiens
ttggccttaccaggtgacttgcaaa

SEQ ID NO: 669 - DNA, 25 bp, Homo sapiens
gccttaccaggtgacttgcaaaggg

SEQ ID NO: 670 - DNA, 25 bp, Homo sapiens
gtttcaaatctctcctttcagggct

SEQ ID NO: 671 - DNA, 25 bp, Homo sapiens
atctctcctttcagggctttatttg

SEQ ID NO: 672 - DNA, 25 bp, Homo sapiens
tcctttcagggctttatttgaatgg

SEQ ID NO: 673 - DNA, 25 bp, Homo sapiens
ctttcagggctttatttgaatggac

SEQ ID NO: 674 - DNA, 25 bp, Homo sapiens
ttatttgaatggacagttcgacctc

SEQ ID NO: 675 - DNA, 25 bp, Homo sapiens
tatttgaatggacagttcgacctct

SEQ ID NO: 676 - DNA, 25 bp, Homo sapiens
tgaatggacagttcgacctcttact

SEQ ID NO: 677 - DNA, 25 bp, Homo sapiens
ggacagttcgacctcttactctctc

SEQ ID NO: 678 - DNA, 25 bp, Homo sapiens
gttcgacctcttactctctcttgtg

SEQ ID NO: 679 - DNA, 25 bp, Homo sapiens
gacctcttactctctcttgtggttt

SEQ ID NO: 680 - DNA, 25 bp, Homo sapiens
aaattcaaggtcctcctctagaagt

SEQ ID NO: 681 - DNA, 25 bp, Homo sapiens
attcaaggtcctcctctagaagttt

SEQ ID NO: 682 - DNA, 25 bp, Homo sapiens
caaggtcctcctctagaagtttcaa

SEQ ID NO: 683 - DNA, 25 bp, Homo sapiens
ggtcctcctctagaagtttcaaatc

SEQ ID NO: 684 - DNA, 25 bp, Homo sapiens
cgaaccagactcagtgaccacgtca

SEQ ID NO: 685 - DNA, 25 bp, Homo sapiens
agactcagtgaccacgtcatgacag

SEQ ID NO: 686 - DNA, 25 bp, Homo sapiens
agtgaccacgtcatgacagaacagc

SEQ ID NO: 687 - DNA, 25 bp, Homo sapiens
cacgtcatgacagaacagcacatcc

SEQ ID NO: 688 - DNA, 25 bp, Homo sapiens
ttaaagggacgagtctgccttcctg

SEQ ID NO: 689 - DNA, 25 bp, Homo sapiens
tctacagacctcatcactggatttg

SEQ ID NO: 690 - DNA, 25 bp, Homo sapiens
ggatttgccaactagaattcgattt

SEQ ID NO: 691 - DNA, 25 bp, Homo sapiens
tagaattcgatttcctgtcatagga

SEQ ID NO: 692 - DNA, 25 bp, Homo sapiens
tcctgtcataggaagctccttggaa

SEQ ID NO: 693 - DNA, 25 bp, Homo sapiens
tgtttacagacctgttttgtcatcc

SEQ ID NO: 694 - DNA, 25 bp, Homo sapiens
cagacctgttttgtcatcctgctgc

SEQ ID NO: 695 - DNA, 25 bp, Homo sapiens
tgttttgtcatcctgctgccaagaa

SEQ ID NO: 696 - DNA, 25 bp, Homo sapiens
gcttgtttccccacggtctggcttc

SEQ ID NO: 697 - DNA, 25 bp, Homo sapiens
cccctgtggggcagccaagttcctg

SEQ ID NO: 698 - DNA, 25 bp, Homo sapiens
tgatagcacttgtgcctcagcccct

SEQ ID NO: 699 - DNA, 25 bp, Homo sapiens
aaggggctgccaacgaaccagactc

SEQ ID NO: 700 - DNA, 25 bp, Homo sapiens
ctcactggtcaataatggtgttgat

SEQ ID NO: 701 - DNA, 25 bp, Homo sapiens
gaaattacaagaagccttcgaccaa

SEQ ID NO: 702 - DNA, 25 bp, Homo sapiens
caagcgtgcagttctccacagtggg

SEQ ID NO: 703 - DNA, 25 bp, Homo sapiens
ctgtctcctgggtttactaagcttg

SEQ ID NO: 704 - DNA, 25 bp, Homo sapiens
taagcttgtagaatgggggaaccca

SEQ ID NO: 705 - DNA, 25 bp, Homo sapiens
gggggaacccactgtatgcccctct

SEQ ID NO: 706 - DNA, 25 bp, Homo sapiens
tctccagcatttggaattccacccg

SEQ ID NO: 707 - DNA, 25 bp, Homo sapiens
acccgccttgctttaagacaaacag

SEQ ID NO: 708 - DNA, 25 bp, Homo sapiens
ctttaagacaaacagggctgctcca

SEQ ID NO: 709 - DNA, 25 bp, Homo sapiens
tgctccaactagttttgtgtcagct

SEQ ID NO: 710 - DNA, 25 bp, Homo sapiens
gctccaactagttttgtgtcagctt

SEQ ID NO: 711 - DNA, 25 bp, Homo sapiens
cctaattcagccagtaaggttcagt

SEQ ID NO: 712 - DNA, 25 bp, Homo sapiens
gatggggccccactgatctggattt

SEQ ID NO: 713 - DNA, 25 bp, Homo sapiens
cccactgatctggatttgaaaagga

SEQ ID NO: 714 - DNA, 25 bp, Homo sapiens
agaagtactaccaaaatgtaactgc

SEQ ID NO: 715 - DNA, 25 bp, Homo sapiens
gaagtactaccaaaatgtaactgct

SEQ ID NO: 716 - DNA, 25 bp, Homo sapiens
ctgagtttgcggagaggtcagtaac

SEQ ID NO: 717 - DNA, 25 bp, Homo sapiens
gctcatgccaaagaagaaaacctta

SEQ ID NO: 718 - DNA, 25 bp, Homo sapiens
aaaccttagtatgcatcagatgctg

SEQ ID NO: 719 - DNA, 25 bp, Homo sapiens
gactttactggagttaaacaacatg

SEQ ID NO: 720 - DNA, 25 bp, Homo sapiens
caacatgtgaaaacctccttagctg

SEQ ID NO: 721 - DNA, 25 bp, Homo sapiens
tgaaaacctccttagctgcgaccac

SEQ ID NO: 722 - DNA, 25 bp, Homo sapiens
gctgcgaccacattctttcattttg

SEQ ID NO: 723 - DNA, 25 bp, Homo sapiens
gaaacatccacaagataccagctag

SEQ ID NO: 724 - DNA, 25 bp, Homo sapiens
caagataccagctaggtcagggggt

SEQ ID NO: 725 - DNA, 25 bp, Homo sapiens
caagcccatgtcagggcgatcctgg

SEQ ID NO: 726 - DNA, 25 bp, Homo sapiens
catgtcagggcgatcctggttcaaa

SEQ ID NO: 727 - DNA, 25 bp, Homo sapiens
aaatgtgccatttcccgggttgatg

SEQ ID NO: 728 - DNA, 25 bp, Homo sapiens
ccatttcccgggttgatgctgccac

SEQ ID NO: 729 - DNA, 25 bp, Homo sapiens
cccgggttgatgctgccacactttg

SEQ ID NO: 730 - DNA, 25 bp, Homo sapiens
gccacactttgtagagagtttagca

SEQ ID NO: 731 - DNA, 25 bp, Homo sapiens
agagtttagcaacacagtgtgctta

SEQ ID NO: 732 - DNA, 25 bp, Homo sapiens
tactatatccagcaagacactaagg

SEQ ID NO: 733 - DNA, 25 bp, Homo sapiens
tatatccagcaagacactaagggtg

SEQ ID NO: 734 - DNA, 25 bp, Homo sapiens
agacactaagggtgctgtacctgtg

SEQ ID NO: 735 - DNA, 25 bp, Homo sapiens
gacactaagggtgctgtacctgtgt

SEQ ID NO: 736 - DNA, 25 bp, Homo sapiens
acactaagggtgctgtacctgtgtg

SEQ ID NO: 737 - DNA, 25 bp, Homo sapiens
actaagggtgctgtacctgtgtggt

SEQ ID NO: 738 - DNA, 25 bp, Homo sapiens
agatggctgaagtccgacacagcac

SEQ ID NO: 739 - DNA, 25 bp, Homo sapiens
ctgaagtccgacacagcacgagcgt

SEQ ID NO: 740 - DNA, 25 bp, Homo sapiens
cctcattttagttgcctaagcattg

SEQ ID NO: 741 - DNA, 25 bp, Homo sapiens
attttagttgcctaagcattgcctg

SEQ ID NO: 742 - DNA, 25 bp, Homo sapiens
tttcctgaacctggtccagtgtatt

SEQ ID NO: 743 - DNA, 25 bp, Homo sapiens
cgctgaccggctgtacgactccata

SEQ ID NO: 744 - DNA, 25 bp, Homo sapiens
tccataatgggcatggggactcaag

SEQ ID NO: 745 - DNA, 25 bp, Homo sapiens
ccataatgggcatggggactcaaga

SEQ ID NO: 746 - DNA, 25 bp, Homo sapiens
gaaagtatagcaagtccctgtacta

SEQ ID NO: 747 - DNA, 25 bp, Homo sapiens
aaagtatagcaagtccctgtactac

SEQ ID NO: 748 - DNA, 25 bp, Homo sapiens
cctgaaggactttctgcttgtcatc

SEQ ID NO: 749 - DNA, 25 bp, Homo sapiens
aggactttctgcttgtcatcccctt

SEQ ID NO: 750 - DNA, 25 bp, Homo sapiens
ctttctgcttgtcatcccctttgac

SEQ ID NO: 751 - DNA, 25 bp, Homo sapiens
ttgtcatcccctttgactgctggga

SEQ ID NO: 752 - DNA, 25 bp, Homo sapiens
agccggggagctgctctctcatgaa

SEQ ID NO: 753 - DNA, 25 bp, Homo sapiens
ggagctgctctctcatgaaacaaga

SEQ ID NO: 754 - DNA, 25 bp, Homo sapiens
tgctctctcatgaaacaagagctag

SEQ ID NO: 755 - DNA, 25 bp, Homo sapiens
acaagagctagaaactcaggatggt

SEQ ID NO: 756 - DNA, 25 bp, Homo sapiens
ctagaaactcaggatggtcatcttg

SEQ ID NO: 757 - DNA, 25 bp, Homo sapiens
aactcaggatggtcatcttggaggg

SEQ ID NO: 758 - DNA, 25 bp, Homo sapiens
caggatggtcatcttggagggacca

SEQ ID NO: 759 - DNA, 25 bp, Homo sapiens
atggtcatcttggagggaccaaggg

SEQ ID NO: 760 - DNA, 25 bp, Homo sapiens
gccctgggccacactgaccctgata

SEQ ID NO: 761 - DNA, 25 bp, Homo sapiens
actgaccctgatacaggcatggcag

SEQ ID NO: 762 - DNA, 25 bp, Homo sapiens
gatacaggcatggcagaagaatggg

SEQ ID NO: 763 - DNA, 25 bp, Homo sapiens
ttattcaagatgttttaccgtaata

SEQ ID NO: 764 - DNA, 25 bp, Homo sapiens
cagttaatgctagtctttcatgtga

SEQ ID NO: 765 - DNA, 25 bp, Homo sapiens
ccttagctgtaagagtctggcttag

SEQ ID NO: 766 - DNA, 25 bp, Homo sapiens
ggcttagaacagacctctctgtgca

SEQ ID NO: 767 - DNA, 25 bp, Homo sapiens
gaacagacctctctgtgcaataact

SEQ ID NO: 768 - DNA, 25 bp, Homo sapiens
ctctgtgcaataacttgtggccact

SEQ ID NO: 769 - DNA, 25 bp, Homo sapiens
tgctctggagggactcggcaccact

SEQ ID NO: 770 - DNA, 25 bp, Homo sapiens
ggactcggcaccacttgatattcaa

SEQ ID NO: 771 - DNA, 25 bp, Homo sapiens
ggcaccacttgatattcaacagcca

SEQ ID NO: 772 - DNA, 25 bp, Homo sapiens
ttgatattcaacagccacttgagcc

SEQ ID NO: 773 - DNA, 25 bp, Homo sapiens
ttgtatttacagctgatggactcaa

SEQ ID NO: 774 - DNA, 25 bp, Homo sapiens
ttacagctgatggactcaatttgag

SEQ ID NO: 775 - DNA, 25 bp, Homo sapiens
tggactcaatttgagccttcaaact

SEQ ID NO: 776 - DNA, 25 bp, Homo sapiens
gagccttcaaacttgtagttatcct

SEQ ID NO: 777 - DNA, 25 bp, Homo sapiens
acattgtctagcattgatttggttc

SEQ ID NO: 778 - DNA, 25 bp, Homo sapiens
cattgtctagcattgatttggttcc

SEQ ID NO: 779 - DNA, 25 bp, Homo sapiens
cattgatttggttcctgtgcatatg

SEQ ID NO: 780 - DNA, 25 bp, Homo sapiens
attctaaacactcgtgcttgcgttt

SEQ ID NO: 781 - DNA, 25 bp, Homo sapiens
taaacactcgtgcttgcgtttgaag

SEQ ID NO: 782 - DNA, 25 bp, Homo sapiens
aacactcgtgcttgcgtttgaagcc

SEQ ID NO: 783 - DNA, 25 bp, Homo sapiens
ctcgtgcttgcgtttgaagcctcgc

SEQ ID NO: 784 - DNA, 25 bp, Homo sapiens
gtgcttgcgtttgaagcctcgcgtc

SEQ ID NO: 785 - DNA, 25 bp, Homo sapiens
tgcttgcgtttgaagcctcgcgtca

SEQ ID NO: 786 - DNA, 25 bp, Homo sapiens
gcttgcgtttgaagcctcgcgtcac

SEQ ID NO: 787 - DNA, 25 bp, Homo sapiens
gcgtttgaagcctcgcgtcactcag

SEQ ID NO: 788 - DNA, 25 bp, Homo sapiens
tgaagcctcgcgtcactcagtcgcg

SEQ ID NO: 789 - DNA, 25 bp, Homo sapiens
aagcctcgcgtcactcagtcgcgtg

SEQ ID NO: 790 - DNA, 25 bp, Homo sapiens
tgttgtctgccttggccgaaagatg

SEQ ID NO: 791 - DNA, 25 bp, Homo sapiens
ctgccttggccgaaagatgaaaaaa

SEQ ID NO: 792 - DNA, 25 bp, Homo sapiens
attcaccggggatctcctgggctgg

SEQ ID NO: 793 - DNA, 25 bp, Homo sapiens
gctctccttggaagtgaggcctttt

SEQ ID NO: 794 - DNA, 25 bp, Homo sapiens
tctccttggaagtgaggccttttat

SEQ ID NO: 795 - DNA, 25 bp, Homo sapiens
tccttggaagtgaggccttttatta

SEQ ID NO: 796 - DNA, 25 bp, Homo sapiens
gtctgtgttctggttgcgctggcca

SEQ ID NO: 797 - DNA, 25 bp, Homo sapiens
ctgtgttctggttgcgctggccatt

SEQ ID NO: 798 - DNA, 25 bp, Homo sapiens
ttctggttgcgctggccattgtcta

SEQ ID NO: 799 - DNA, 25 bp, Homo sapiens
gcgctggccattgtctatctcattg

SEQ ID NO: 800 - DNA, 25 bp, Homo sapiens
gccattgtctatctcattgccttgg

SEQ ID NO: 801 - DNA, 25 bp, Homo sapiens
ggctgtctgtcagtgccgccgaaag

SEQ ID NO: 802 - DNA, 25 bp, Homo sapiens
gctgtctgtcagtgccgccgaaaga

SEQ ID NO: 803 - DNA, 25 bp, Homo sapiens
tcagtgccgccgaaagaactacggg

SEQ ID NO: 804 - DNA, 25 bp, Homo sapiens
ccgccgaaagaactacgggcagctg

SEQ ID NO: 805 - DNA, 25 bp, Homo sapiens
gaactacgggcagctggacatcttt

SEQ ID NO: 806 - DNA, 25 bp, Homo sapiens
cgggcagctggacatctttccagcc

SEQ ID NO: 807 - DNA, 25 bp, Homo sapiens
ggacatctttccagcccgggatacc

SEQ ID NO: 808 - DNA, 25 bp, Homo sapiens
agcccgggatacctaccatcctatg

SEQ ID NO: 809 - DNA, 25 bp, Homo sapiens
gcccgggatacctaccatcctatga

SEQ ID NO: 810 - DNA, 25 bp, Homo sapiens
acctaccatcctatgagcgagtacc

SEQ ID NO: 811 - DNA, 25 bp, Homo sapiens
taccatcctatgagcgagtacccca

SEQ ID NO: 812 - DNA, 25 bp, Homo sapiens
acaagctggccagaagggagaccag

SEQ ID NO: 813 - DNA, 25 bp, Homo sapiens
aggtgaaaactcagtgtccgtcagg

SEQ ID NO: 814 - DNA, 25 bp, Homo sapiens
aggccgggctgaagtttactacagt

SEQ ID NO: 815 - DNA, 25 bp, Homo sapiens
ccctgtacaaagtgggagctggcac

SEQ ID NO: 816 - DNA, 25 bp, Homo sapiens
cggagagtaccctgtggagctgcac

SEQ ID NO: 817 - DNA, 25 bp, Homo sapiens
ggagagtaccctgtggagctgcacc

SEQ ID NO: 818 - DNA, 25 bp, Homo sapiens
gtaccctgtggagctgcaccaagaa

SEQ ID NO: 819 - DNA, 25 bp, Homo sapiens
ccctgtggagctgcaccaagaatag

SEQ ID NO: 820 - DNA, 25 bp, Homo sapiens
tgtggagctgcaccaagaatagctg

SEQ ID NO: 821 - DNA, 25 bp, Homo sapiens
gcaccaagaatagctggggccatca

SEQ ID NO: 822 - DNA, 25 bp, Homo sapiens
atagctggggccatcatgactgcag

SEQ ID NO: 823 - DNA, 25 bp, Homo sapiens
gtgcagcgtctgacccggaaaccct

SEQ ID NO: 824 - DNA, 25 bp, Homo sapiens
gtgtcctcgggctcatatgtgggaa

SEQ ID NO: 825 - DNA, 25 bp, Homo sapiens
gcagaggatctctgaggagttccct

SEQ ID NO: 826 - DNA, 25 bp, Homo sapiens
tgaggagttccctggggacaactga

SEQ ID NO: 827 - DNA, 25 bp, Homo sapiens
ggacaactgagcagcctctggagag

SEQ ID NO: 828 - DNA, 25 bp, Homo sapiens
taaataccagactgcaggttggacc

SEQ ID NO: 829 - DNA, 25 bp, Homo sapiens
ttacagctccccaagtggtttccac

SEQ ID NO: 830 - DNA, 25 bp, Homo sapiens
ggtttccacatgctctgagaagagg

SEQ ID NO: 831 - DNA, 25 bp, Homo sapiens
ccctcatcttgaagggcccaggagg

SEQ ID NO: 832 - DNA, 25 bp, Homo sapiens
gagaggaactccttggcctagccca

SEQ ID NO: 833 - DNA, 25 bp, Homo sapiens
tgctgccttctgacggccctgcaat

SEQ ID NO: 834 - DNA, 25 bp, Homo sapiens
cacatgctggccagcctggggcctg

SEQ ID NO: 835 - DNA, 25 bp, Homo sapiens
gaggtcaggccctggaactctatct

SEQ ID NO: 836 - DNA, 25 bp, Homo sapiens
gtcaggccctggaactctatctggg

SEQ ID NO: 837 - DNA, 25 bp, Homo sapiens
ctggaactctatctgggcctgggct

SEQ ID NO: 838 - DNA, 25 bp, Homo sapiens
tggaactctatctgggcctgggcta

SEQ ID NO: 839 - DNA, 25 bp, Homo sapiens
ggacatcagaggttctttgagggac

SEQ ID NO: 840 - DNA, 25 bp, Homo sapiens
gacatcagaggttctttgagggact

SEQ ID NO: 841 - DNA, 25 bp, Homo sapiens
gagggactgcctctgccacactctg

SEQ ID NO: 842 - DNA, 25 bp, Homo sapiens
agggactgcctctgccacactctga

SEQ ID NO: 843 - DNA, 25 bp, Homo sapiens
ttccactgcctctgccttagaggag

SEQ ID NO: 844 - DNA, 25 bp, Homo sapiens
cccgctggacttataatgccacctt

SEQ ID NO: 845 - DNA, 25 bp, Homo sapiens
ccgctggacttataatgccaccttc

SEQ ID NO: 846 - DNA, 25 bp, Homo sapiens
ctggacttataatgccaccttctgt

SEQ ID NO: 847 - DNA, 25 bp, Homo sapiens
tgcacccttggctctggccaaagct

SEQ ID NO: 848 - DNA, 25 bp, Homo sapiens
gcacccttggctctggccaaagctt

SEQ ID NO: 849 - DNA, 25 bp, Homo sapiens
acctgcgtggctctgttactacagc

SEQ ID NO: 850 - DNA, 25 bp, Homo sapiens
ctgcgtggctctgttactacagcca

SEQ ID NO: 851 - DNA, 25 bp, Homo sapiens
gcgtggctctgttactacagccact

SEQ ID NO: 852 - DNA, 25 bp, Homo sapiens
gtggctctgttactacagccactgc

SEQ ID NO: 853 - DNA, 25 bp, Homo sapiens
tggctctgttactacagccactgct

SEQ ID NO: 854 - DNA, 25 bp, Homo sapiens
ggctctgttactacagccactgctg

SEQ ID NO: 855 - DNA, 25 bp, Homo sapiens
ctctgttactacagccactgctggg

SEQ ID NO: 856 - DNA, 25 bp, Homo sapiens
gttactacagccactgctgggtgcc

SEQ ID NO: 857 - DNA, 25 bp, Homo sapiens
ttactacagccactgctgggtgccc

SEQ ID NO: 858 - DNA, 25 bp, Homo sapiens
actacagccactgctgggtgcccag

SEQ ID NO: 859 - DNA, 25 bp, Homo sapiens
tacagccactgctgggtgcccaggg

SEQ ID NO: 860 - DNA, 25 bp, Homo sapiens
ctagccagaagtggaattggcagct

SEQ ID NO: 861 - DNA, 25 bp, Homo sapiens
aattggcagcttctagaatatgtac

SEQ ID NO: 862 - DNA, 25 bp, Homo sapiens
ggacaaaatgttcctcaatcttaag

SEQ ID NO: 863 - DNA, 25 bp, Homo sapiens
atacaaagaccctcattgtctgggt

SEQ ID NO: 864 - DNA, 25 bp, Homo sapiens
tcccacacttactgagtacagatga

SEQ ID NO: 865 - DNA, 25 bp, Homo sapiens
aacattacattcaggggatttcctc

SEQ ID NO: 866 - DNA, 25 bp, Homo sapiens
ggctcagtcttttccccttgaagtt

SEQ ID NO: 867 - DNA, 25 bp, Homo sapiens
tccccttgaagttctctaatagatg

SEQ ID NO: 868 - DNA, 25 bp, Homo sapiens
cttgaagttctctaatagatgttac

SEQ ID NO: 869 - DNA, 25 bp, Homo sapiens
atgttacttttgacaaaagatcgcc

SEQ ID NO: 870 - DNA, 25 bp, Homo sapiens
gtcaaactgtcaaaaagcccagaat

SEQ ID NO: 871 - DNA, 25 bp, Homo sapiens
cccagaattcccaaaggcattaggt

SEQ ID NO: 872 - DNA, 25 bp, Homo sapiens
gctgatatcagaacagcagaaatta

SEQ ID NO: 873 - DNA, 25 bp, Homo sapiens
atgtttctgatgacttatgttctac

SEQ ID NO: 874 - DNA, 25 bp, Homo sapiens
caatctatggacatacgggattttt

SEQ ID NO: 875 - DNA, 25 bp, Homo sapiens
ttttcttgctttgaagctacctgga

SEQ ID NO: 876 - DNA, 25 bp, Homo sapiens
cacggccagtgtcacgtacagcatc

SEQ ID NO: 877 - DNA, 25 bp, Homo sapiens
tgtcacgtacagcatctgtggttcc

SEQ ID NO: 878 - DNA, 25 bp, Homo sapiens
tcacgtacagcatctgtggttccag

SEQ ID NO: 879 - DNA, 25 bp, Homo sapiens
acagcatctgtggttccagtctgtg

SEQ ID NO: 880 - DNA, 25 bp, Homo sapiens
catctgtggttccagtctgtgcttg

SEQ ID NO: 881 - DNA, 25 bp, Homo sapiens
tgtggttccagtctgtgcttgacat

SEQ ID NO: 882 - DNA, 25 bp, Homo sapiens
ccatcccactggagtcagggggctc

SEQ ID NO: 883 - DNA, 25 bp, Homo sapiens
catcccactggagtcagggggctcg

SEQ ID NO: 884 - DNA, 25 bp, Homo sapiens
atcacccttcgcagctatgtgcggg

SEQ ID NO: 885 - DNA, 25 bp, Homo sapiens
tcacccttcgcagctatgtgcgggc

SEQ ID NO: 886 - DNA, 25 bp, Homo sapiens
gcaacagcgccgagcgcctgctgga

SEQ ID NO: 887 - DNA, 25 bp, Homo sapiens
gcgcgcgccgtggagaaccagtact

SEQ ID NO: 888 - DNA, 25 bp, Homo sapiens
cgcgccgtggagaaccagtactcct

SEQ ID NO: 889 - DNA, 25 bp, Homo sapiens
gtggagaaccagtactccttctact

SEQ ID NO: 890 - DNA, 25 bp, Homo sapiens
gagaaccagtactccttctactagc

SEQ ID NO: 891 - DNA, 25 bp, Homo sapiens
gtgggacacgccaagctcttcagtg

SEQ ID NO: 892 - DNA, 25 bp, Homo sapiens
ctctagaatctgtgcggctgctcaa

SEQ ID NO: 893 - DNA, 25 bp, Homo sapiens
caatgcagcactcaacagcaagctc

SEQ ID NO: 894 - DNA, 25 bp, Homo sapiens
agcactcaacagcaagctctgtgat

SEQ ID NO: 895 - DNA, 25 bp, Homo sapiens
gtgatctcctgctctccaagcatgg

SEQ ID NO: 896 - DNA, 25 bp, Homo sapiens
ggtgaagagctcctgcgcttggcac

SEQ ID NO: 897 - DNA, 25 bp, Homo sapiens
ccacagccctcagatgatggaagat

SEQ ID NO: 898 - DNA, 25 bp, Homo sapiens
attttgtggagaagctgctgctggc

SEQ ID NO: 899 - DNA, 25 bp, Homo sapiens
ctgtcgccgtcctgtacactttgag

SEQ ID NO: 900 - DNA, 25 bp, Homo sapiens
gtacactttgagctcatgagtgagt

SEQ ID NO: 901 - DNA, 25 bp, Homo sapiens
ctacttcgggaacatggggccccag

SEQ ID NO: 902 - DNA, 25 bp, Homo sapiens
ggggccccagtatgtcaccacctat

SEQ ID NO: 903 - DNA, 25 bp, Homo sapiens
gtatgtcaccacctatgcctgagaa

SEQ ID NO: 904 - DNA, 25 bp, Homo sapiens
ctgagaagccagctgcctaggattc

SEQ ID NO: 905 - DNA, 25 bp, Homo sapiens
caggcctactcctgtcttctgcttt

SEQ ID NO: 906 - DNA, 25 bp, Homo sapiens
ttgttgtgtgcctctagctgaattg

SEQ ID NO: 907 - DNA, 25 bp, Homo sapiens
gcctctagctgaattgagcctaaaa

SEQ ID NO: 908 - DNA, 25 bp, Homo sapiens
tttctgttgctattgatgcaggtca

SEQ ID NO: 909 - DNA, 25 bp, Homo sapiens
ttgatgcaggtcatgagtccttcct

SEQ ID NO: 910 - DNA, 25 bp, Homo sapiens
caggtcatgagtccttcctgttcta

SEQ ID NO: 911 - DNA, 25 bp, Homo sapiens
catgagtccttcctgttctataaag

SEQ ID NO: 912 - DNA, 25 bp, Homo sapiens
atgagtccttcctgttctataaaga

SEQ ID NO: 913 - DNA, 25 bp, Homo sapiens
agtccttcctgttctataaagaagg

SEQ ID NO: 914 - DNA, 25 bp, Homo sapiens
tttgagccagactgtagcagtgaag

SEQ ID NO: 915 - DNA, 25 bp, Homo sapiens
ccagactgtagcagtgaagacatgg

SEQ ID NO: 916 - DNA, 25 bp, Homo sapiens
ccaaagaccggagaaaccattgtgg

SEQ ID NO: 917 - DNA, 25 bp, Homo sapiens
accggagaaaccattgtggaattgc

SEQ ID NO: 918 - DNA, 25 bp, Homo sapiens
gaaaccattgtggaattgcctcagc

SEQ ID NO: 919 - DNA, 25 bp, Homo sapiens
atggcgcatgcatgggaggaattca

SEQ ID NO: 920 - DNA, 25 bp, Homo sapiens
gaggaattcatcttcagtctaccag

SEQ ID NO: 921 - DNA, 25 bp, Homo sapiens
ggaattcatcttcagtctaccagcc

SEQ ID NO: 922 - DNA, 25 bp, Homo sapiens
ccgctgtgtcggatacacactcgaa

SEQ ID NO: 923 - DNA, 25 bp, Homo sapiens
cgctgtgtcggatacacactcgaat

SEQ ID NO: 924 - DNA, 25 bp, Homo sapiens
gtgggcgtttcttcttgtacttatg

SEQ ID NO: 925 - DNA, 25 bp, Homo sapiens
gggcgtttcttcttgtacttatgtg

SEQ ID NO: 926 - DNA, 25 bp, Homo sapiens
ctcttcccgagatggggccgccgag

SEQ ID NO: 927 - DNA, 25 bp, Homo sapiens
tgctgcgcttccagttccgaaaagc

SEQ ID NO: 928 - DNA, 25 bp, Homo sapiens
tgtttaagcccttggactgagggtg

SEQ ID NO: 929 - DNA, 25 bp, Homo sapiens
atcgcagctccgaagacggagagga

SEQ ID NO: 930 - DNA, 25 bp, Homo sapiens
acccacgtgccctagattcatggca

SEQ ID NO: 931 - DNA, 25 bp, Homo sapiens
gccctagattcatggcagaaaatga

SEQ ID NO: 932 - DNA, 25 bp, Homo sapiens
tagattcatggcagaaaatgaccaa

SEQ ID NO: 933 - DNA, 25 bp, Homo sapiens
cagaaaatgaccaaatcctgtgtat

SEQ ID NO: 934 - DNA, 25 bp, Homo sapiens
aatgaccaaatcctgtgtatttgtt

SEQ ID NO: 935 - DNA, 25 bp, Homo sapiens
gctattgctgtagtaagagaagctc

SEQ ID NO: 936 - DNA, 25 bp, Homo sapiens
aagagaagctctttgtatctgaaca

SEQ ID NO: 937 - DNA, 25 bp, Homo sapiens
agaagctctttgtatctgaacatag

SEQ ID NO: 938 - DNA, 25 bp, Homo sapiens
agctctttgtatctgaacatagttg

SEQ ID NO: 939 - DNA, 25 bp, Homo sapiens
ctctttgtatctgaacatagttgta

SEQ ID NO: 940 - DNA, 25 bp, Homo sapiens
gtcagccaggcctgccaggtcttca

SEQ ID NO: 941 - DNA, 25 bp, Homo sapiens
caggacaggtgtcctggcctttctt

SEQ ID NO: 942 - DNA, 25 bp, Homo sapiens
gtgtcctggcctttcttcctgaggt

SEQ ID NO: 943 - DNA, 25 bp, Homo sapiens
gcctttcttcctgaggtctctaggg

SEQ ID NO: 944 - DNA, 25 bp, Homo sapiens
tttcttcctgaggtctctaggggag

SEQ ID NO: 945 - DNA, 25 bp, Homo sapiens
gattatgtctgctgtcatgtctggg

SEQ ID NO: 946 - DNA, 25 bp, Homo sapiens
catgtctgggtctttagggtaggac

SEQ ID NO: 947 - DNA, 25 bp, Homo sapiens
aggcaggagtctccacaaggcttca

SEQ ID NO: 948 - DNA, 25 bp, Homo sapiens
acaaggcttcatgtggccccttata

SEQ ID NO: 949 - DNA, 25 bp, Homo sapiens
ggaaggtcccttcatgctggaggca

SEQ ID NO: 950 - DNA, 25 bp, Homo sapiens
cacacagctttaaggaagtaggttg

SEQ ID NO: 951 - DNA, 25 bp, Homo sapiens
gttgaagtaggactccttcgtcctc

SEQ ID NO: 952 - DNA, 25 bp, Homo sapiens
taggactccttcgtcctctcactgg

SEQ ID NO: 953 - DNA, 25 bp, Homo sapiens
cttcgtcctctcactggctttggct

SEQ ID NO: 954 - DNA, 25 bp, Homo sapiens
ttcgtcctctcactggctttggctc

SEQ ID NO: 955 - DNA, 25 bp, Homo sapiens
tctcactggctttggctccctcaat

SEQ ID NO: 956 - DNA, 25 bp, Homo sapiens
cccacgtggtagtgggagatgttct

SEQ ID NO: 957 - DNA, 25 bp, Homo sapiens
agccgatgtggacaagaccgtggct

SEQ ID NO: 958 - DNA, 25 bp, Homo sapiens
gcaatgacctcagtcccacgacagt

SEQ ID NO: 959 - DNA, 25 bp, Homo sapiens
atgcacaaggtgctgcgggaatcag

SEQ ID NO: 960 - DNA, 25 bp, Homo sapiens
atgccgccacacataggagaccagc

SEQ ID NO: 961 - DNA, 25 bp, Homo sapiens
cacataggagaccagccactaactg

SEQ ID NO: 962 - DNA, 25 bp, Homo sapiens
tcaagggtcatctccaaacatgacc

SEQ ID NO: 963 - DNA, 25 bp, Homo sapiens
gtcatctccaaacatgacctgggcc

SEQ ID NO: 964 - DNA, 25 bp, Homo sapiens
ccaaacatgacctgggccatttcat

SEQ ID NO: 965 - DNA, 25 bp, Homo sapiens
gcctcaccaccgatgagtacgacgg

SEQ ID NO: 966 - DNA, 25 bp, Homo sapiens
accgatgagtacgacggacacagca

SEQ ID NO: 967 - DNA, 25 bp, Homo sapiens
gagtacgacggacacagcacctacc

SEQ ID NO: 968 - DNA, 25 bp, Homo sapiens
agtaccagtagcactctgtccccat

SEQ ID NO: 969 - DNA, 25 bp, Homo sapiens
agtagcactctgtccccatctggga

SEQ ID NO: 970 - DNA, 25 bp, Homo sapiens
cattctgggacatgaggagcaaagg

SEQ ID NO: 971 - DNA, 25 bp, Homo sapiens
tgttgagccaagagcttcaaattac

SEQ ID NO: 972 - DNA, 25 bp, Homo sapiens
gaccagcaacagaagcccttatacc

SEQ ID NO: 973 - DNA, 25 bp, Homo sapiens
actgctatcaacacggagaacatcc

SEQ ID NO: 974 - DNA, 25 bp, Homo sapiens
gatactattctgcatgacaacctca

SEQ ID NO: 975 - DNA, 25 bp, Homo sapiens
attctgcatgacaacctcaagcagc

SEQ ID NO: 976 - DNA, 25 bp, Homo sapiens
catgacaacctcaagcagcttatgc

SEQ ID NO: 977 - DNA, 25 bp, Homo sapiens
aacctcaagcagcttatgctacagt

SEQ ID NO: 978 - DNA, 25 bp, Homo sapiens
tctgcggcctttggtttgtggctga

SEQ ID NO: 979 - DNA, 25 bp, Homo sapiens
gcctttggtttgtggctgaaagctg

SEQ ID NO: 980 - DNA, 25 bp, Homo sapiens
gttgagtgactcatcgccaagattt

SEQ ID NO: 981 - DNA, 25 bp, Homo sapiens
tgactcatcgccaagatttgctgta

SEQ ID NO: 982 - DNA, 25 bp, Homo sapiens
atcgccaagatttgctgtaatgcag

SEQ ID NO: 983 - DNA, 25 bp, Homo sapiens
gaagatcgactgaccaatcgcctta

SEQ ID NO: 984 - DNA, 25 bp, Homo sapiens
cgccttacagagtctctgaacattt

SEQ ID NO: 985 - DNA, 25 bp, Homo sapiens
acagagtctctgaacatttttgaaa

SEQ ID NO: 986 - DNA, 25 bp, Homo sapiens
tctctgaacatttttgaaacaatcg

SEQ ID NO: 987 - DNA, 25 bp, Homo sapiens
gttttcagcaatgtctccataattc

SEQ ID NO: 988 - DNA, 25 bp, Homo sapiens
cctagggtaccagcaggcagagcct

SEQ ID NO: 989 - DNA, 25 bp, Homo sapiens
tagggtaccagcaggcagagccttg

SEQ ID NO: 990 - DNA, 25 bp, Homo sapiens
gtaccagcaggcagagccttgccct

SEQ ID NO: 991 - DNA, 25 bp, Homo sapiens
gcagagccttgccctctgctcaggc

SEQ ID NO: 992 - DNA, 25 bp, Homo sapiens
gaggggcccaaaatctctgctcaga

SEQ ID NO: 993 - DNA, 25 bp, Homo sapiens
ggcccaaaatctctgctcagagaag

SEQ ID NO: 994 - DNA, 25 bp, Homo sapiens
cccaaaatctctgctcagagaagtg

SEQ ID NO: 995 - DNA, 25 bp, Homo sapiens
aaatctctgctcagagaagtgcagg

SEQ ID NO: 996 - DNA, 25 bp, Homo sapiens
atctctgctcagagaagtgcagggg

SEQ ID NO: 997 - DNA, 25 bp, Homo sapiens
ctcactctccctgaggactggcgtg

SEQ ID NO: 998 - DNA, 25 bp, Homo sapiens
cactctccctgaggactggcgtgac

SEQ ID NO: 999 - DNA, 25 bp, Homo sapiens
ctctccctgaggactggcgtgacag

SEQ ID NO: 1000 - DNA, 25 bp, Homo sapiens
ctccctgaggactggcgtgacaggg

SEQ ID NO: 1001 - DNA, 25 bp, Homo sapiens
ggggcagttacctggttgctgtttt

SEQ ID NO: 1002 - DNA, 25 bp, Homo sapiens
ggcagttacctggttgctgttttaa

SEQ ID NO: 1003 - DNA, 25 bp, Homo sapiens
cagttacctggttgctgttttaatt

SEQ ID NO: 1004 - DNA, 25 bp, Homo sapiens
gagaatgtttgtcactcccaaaaat

SEQ ID NO: 1005 - DNA, 25 bp, Homo sapiens
cccaaaaatatctggagaggaagaa

SEQ ID NO: 1006 - DNA, 25 bp, Homo sapiens
gattggcattgagatccatgtggac

SEQ ID NO: 1007 - DNA, 25 bp, Homo sapiens
ctgtctgaaagctggcattcatcca

SEQ ID NO: 1008 - DNA, 25 bp, Homo sapiens
actgctctcataaagatctgattgc

SEQ ID NO: 1009 - DNA, 25 bp, Homo sapiens
ctctcataaagatctgattgccttg

SEQ ID NO: 1010 - DNA, 25 bp, Homo sapiens
cccaactcccattgcagaagaaaag

SEQ ID NO: 1011 - DNA, 25 bp, Homo sapiens
tcccattgcagaagaaaagctattc

SEQ ID NO: 1012 - DNA, 25 bp, Homo sapiens
aaagctattcaactctcagcggtgg

SEQ ID NO: 1013 - DNA, 25 bp, Homo sapiens
agctattcaactctcagcggtggag

SEQ ID NO: 1014 - DNA, 25 bp, Homo sapiens
cagacgcggatcttggaaatccagg

SEQ ID NO: 1015 - DNA, 25 bp, Homo sapiens
atcttggaaatccaggacttcttgg

SEQ ID NO: 1016 - DNA, 25 bp, Homo sapiens
acagaactacaggtgcacccaacca

SEQ ID NO: 1017 - DNA, 25 bp, Homo sapiens
tcccttgatgggacaacatcctgta

SEQ ID NO: 1018 - DNA, 25 bp, Homo sapiens
aggtgcacccaaccacggacatgca

SEQ ID NO: 1019 - DNA, 25 bp, Homo sapiens
ctcgtcatgagaaatctaggtaggc

SEQ ID NO: 1020 - DNA, 25 bp, Homo sapiens
cctaacagagtttactgttgtttag

SEQ ID NO: 1021 - DNA, 25 bp, Homo sapiens
atttgcaagggcttcttttccgcaa

SEQ ID NO: 1022 - DNA, 25 bp, Homo sapiens
ttgcaagggcttcttttccgcaaat

SEQ ID NO: 1023 - DNA, 25 bp, Homo sapiens
ctaattagtgccaccagactagacc

SEQ ID NO: 1024 - DNA, 25 bp, Homo sapiens
aattagtgccaccagactagacctg

SEQ ID NO: 1025 - DNA, 25 bp, Homo sapiens
tagtgccaccagactagacctgtat

SEQ ID NO: 1026 - DNA, 25 bp, Homo sapiens
tgccaccagactagacctgtatcat

SEQ ID NO: 1027 - DNA, 25 bp, Homo sapiens
cagactagacctgtatcattcatgg

SEQ ID NO: 1028 - DNA, 25 bp, Homo sapiens
agacctgtatcattcatggtataaa

SEQ ID NO: 1029 - DNA, 25 bp, Homo sapiens
gacctgtatcattcatggtataaat

SEQ ID NO: 1030 - DNA, 25 bp, Homo sapiens
atctctctcttaaaacgagatcagg

SEQ ID NO: 1031 - DNA, 25 bp, Homo sapiens
tctcttaaaacgagatcaggttagc

SEQ ID NO: 1032 - DNA, 25 bp, Homo sapiens
ttataccctttttggcctgaagaca

SEQ ID NO: 1033 - DNA, 25 bp, Homo sapiens
cctttttggcctgaagacattttag

SEQ ID NO: 1034 - DNA, 25 bp, Homo sapiens
tggcctgaagacattttagaatttc

SEQ ID NO: 1035 - DNA, 25 bp, Homo sapiens
tagaatttcctaacagagtttactg

SEQ ID NO: 1036 - DNA, 25 bp, Homo sapiens
agggttctctgtgtgtgtccccggc

SEQ ID NO: 1037 - DNA, 25 bp, Homo sapiens
ggttctctgtgtgtgtccccggcac

SEQ ID NO: 1038 - DNA, 25 bp, Homo sapiens
gttctctgtgtgtgtccccggcacg

SEQ ID NO: 1039 - DNA, 25 bp, Homo sapiens
ttctctgtgtgtgtccccggcacgt

SEQ ID NO: 1040 - DNA, 25 bp, Homo sapiens
tctctgtgtgtgtccccggcacgtc

SEQ ID NO: 1041 - DNA, 25 bp, Homo sapiens
cgcctccgttaacacgatcctgaat

SEQ ID NO: 1042 - DNA, 25 bp, Homo sapiens
gcctccgttaacacgatcctgaata

SEQ ID NO: 1043 - DNA, 25 bp, Homo sapiens
aacacgatcctgaataaatcttgag

SEQ ID NO: 1044 - DNA, 25 bp, Homo sapiens
cacgatcctgaataaatcttgagaa

SEQ ID NO: 1045 - DNA, 25 bp, Homo sapiens
acgatcctgaataaatcttgagaac

SEQ ID NO: 1046 - DNA, 25 bp, Homo sapiens
cgatcctgaataaatcttgagaacc

SEQ ID NO: 1047 - DNA, 25 bp, Homo sapiens
gatcctgaataaatcttgagaaccc

SEQ ID NO: 1048 - DNA, 25 bp, Homo sapiens
agggcagctccctggcatactggct

SEQ ID NO: 1049 - DNA, 25 bp, Homo sapiens
gcatactggctgcagcccgtgggca

SEQ ID NO: 1050 - DNA, 25 bp, Homo sapiens
catactggctgcagcccgtgggcag

SEQ ID NO: 1051 - DNA, 25 bp, Homo sapiens
gcagctccgggctgtcgtccataga

SEQ ID NO: 1052 - DNA, 25 bp, Homo sapiens
gccactggtgcctcgagtagccatg

SEQ ID NO: 1053 - DNA, 25 bp, Homo sapiens
tgtccagtcacttagaagttccccc

SEQ ID NO: 1054 - DNA, 25 bp, Homo sapiens
ggccaaaaacccaattcacattgag

SEQ ID NO: 1055 - DNA, 25 bp, Homo sapiens
tctgaagttttcgtatcacagtgtt

SEQ ID NO: 1056 - DNA, 25 bp, Homo sapiens
gtgttaacctgtactctctcctgca

SEQ ID NO: 1057 - DNA, 25 bp, Homo sapiens
attccagtatcaatgctacacagtg

SEQ ID NO: 1058 - DNA, 25 bp, Homo sapiens
aatgctacacagtgttgtcccgagc

SEQ ID NO: 1059 - DNA, 25 bp, Homo sapiens
gcgttgggcagaaaccctcgggaat

SEQ ID NO: 1060 - DNA, 25 bp, Homo sapiens
cacgctgtagggtatgggaagaacc

SEQ ID NO: 1061 - DNA, 25 bp, Homo sapiens
ctaataaagctgctgcttggctgga

SEQ ID NO: 1062 - DNA, 25 bp, Homo sapiens
aaagctgctgcttggctggaaaaaa

SEQ ID NO: 1063 - DNA, 25 bp, Homo sapiens
ttggggctcccgtggacagtctcag

SEQ ID NO: 1064 - DNA, 25 bp, Homo sapiens
ggggctcccgtggacagtctcagcc

SEQ ID NO: 1065 - DNA, 25 bp, Homo sapiens
accagcacctgcatgtaccctagaa

SEQ ID NO: 1066 - DNA, 25 bp, Homo sapiens
caccgattggtgtccggctggtgac

SEQ ID NO: 1067 - DNA, 25 bp, Homo sapiens
tccctggtttggtgtcctggcccca

SEQ ID NO: 1068 - DNA, 25 bp, Homo sapiens
gcccatgcttcgacggggcagcagc

SEQ ID NO: 1069 - DNA, 25 bp, Homo sapiens
cagcagcaagtggatggccaggaca

SEQ ID NO: 1070 - DNA, 25 bp, Homo sapiens
agccaatagccgtcctcatgtacgt

SEQ ID NO: 1071 - DNA, 25 bp, Homo sapiens
tagccgtcctcatgtacgtccacga

SEQ ID NO: 1072 - DNA, 25 bp, Homo sapiens
gtcctcatgtacgtccacgactact

SEQ ID NO: 1073 - DNA, 25 bp, Homo sapiens
tcatgtacgtccacgactactacgt

SEQ ID NO: 1074 - DNA, 25 bp, Homo sapiens
gtccacgactactacgtgctcaact

SEQ ID NO: 1075 - DNA, 25 bp, Homo sapiens
cacgactactacgtgctcaactatg

SEQ ID NO: 1076 - DNA, 25 bp, Homo sapiens
ctacgtgctcaactatgaggcccca

SEQ ID NO: 1077 - DNA, 25 bp, Homo sapiens
gtgctcaactatgaggccccagcgg

SEQ ID NO: 1078 - DNA, 25 bp, Homo sapiens
tgctcaactatgaggccccagcggc

SEQ ID NO: 1079 - DNA, 25 bp, Homo sapiens
ctatgaggccccagcggcagaggcc

SEQ ID NO: 1080 - DNA, 25 bp, Homo sapiens
cggcagaggcctgagctgcacctga

SEQ ID NO: 1081 - DNA, 25 bp, Homo sapiens
cacctgagggcctggcttctcactg

SEQ ID NO: 1082 - DNA, 25 bp, Homo sapiens
tgagggcctggcttctcactgccac

SEQ ID NO: 1083 - DNA, 25 bp, Homo sapiens
ctcctaggcctcgagtgctggggat

SEQ ID NO: 1084 - DNA, 25 bp, Homo sapiens
gccgtgcaggccatgaaccgcatct

SEQ ID NO: 1085 - DNA, 25 bp, Homo sapiens
atgaaccgcatctgtgtgctggacg

SEQ ID NO: 1086 - DNA, 25 bp, Homo sapiens
gatctgcggcccatctacatctctg

SEQ ID NO: 1087 - DNA, 25 bp, Homo sapiens
cggcccatctacatctctgtgcagc

SEQ ID NO: 1088 - DNA, 25 bp, Homo sapiens
ccgccttcactgcacgtgctggagc

SEQ ID NO: 1089 - DNA, 25 bp, Homo sapiens
ctgcggcagcgcaacactgaaaccg

SEQ ID NO: 1090 - DNA, 25 bp, Homo sapiens
ctgtttgatgtggtcatcattaacg

SEQ ID NO: 1091 - DNA, 25 bp, Homo sapiens
gacagcctggaccaggcctacgcag

SEQ ID NO: 1092 - DNA, 25 bp, Homo sapiens
ctggaccaggcctacgcagagctga

SEQ ID NO: 1093 - DNA, 25 bp, Homo sapiens
gcgctctctgaggaaatcaagaaag

SEQ ID NO: 1094 - DNA, 25 bp, Homo sapiens
ggcgcctgaggcttgctgtctgttc

SEQ ID NO: 1095 - DNA, 25 bp, Homo sapiens
tacaggaccagggcagcagcattga

SEQ ID NO: 1096 - DNA, 25 bp, Homo sapiens
accagggcagcagcattgagccacc

SEQ ID NO: 1097 - DNA, 25 bp, Homo sapiens
cgatacggcagctctgtgcccttgg

SEQ ID NO: 1098 - DNA, 25 bp, Homo sapiens
ggcagctctgtgcccttggccagca

SEQ ID NO: 1099 - DNA, 25 bp, Homo sapiens
ctcactctggacccagggctgacat

SEQ ID NO: 1100 - DNA, 25 bp, Homo sapiens
gtcgtgtgcttggaggaagccgcgg

SEQ ID NO: 1101 - DNA, 25 bp, Homo sapiens
cgtgtgcttggaggaagccgcggaa

SEQ ID NO: 1102 - DNA, 25 bp, Homo sapiens
gaagccgcggaacccccagcgtccg

SEQ ID NO: 1103 - DNA, 25 bp, Homo sapiens
cccagcgtccgtccatggcgtggag

SEQ ID NO: 1104 - DNA, 25 bp, Homo sapiens
cgtccatggcgtggagccttgggag

SEQ ID NO: 1105 - DNA, 25 bp, Homo sapiens
ccatggcgtggagccttgggagctg

SEQ ID NO: 1106 - DNA, 25 bp, Homo sapiens
atggcgtggagccttgggagctggc

SEQ ID NO: 1107 - DNA, 25 bp, Homo sapiens
ggcgtggagccttgggagctggctg

SEQ ID NO: 1108 - DNA, 25 bp, Homo sapiens
gcgtggagccttgggagctggctgg

SEQ ID NO: 1109 - DNA, 25 bp, Homo sapiens
gtggagccttgggagctggctgggt

SEQ ID NO: 1110 - DNA, 25 bp, Homo sapiens
ggagccttgggagctggctgggtgg

SEQ ID NO: 1111 - DNA, 25 bp, Homo sapiens
gaccccaaatcctgaccatattaat

SEQ ID NO: 1112 - DNA, 25 bp, Homo sapiens
ccccaaatcctgaccatattaatgc

SEQ ID NO: 1113 - DNA, 25 bp, Homo sapiens
caaatcctgaccatattaatgcccc

SEQ ID NO: 1114 - DNA, 25 bp, Homo sapiens
aatcctgaccatattaatgcccctg

SEQ ID NO: 1115 - DNA, 25 bp, Homo sapiens
atcctgaccatattaatgcccctga

SEQ ID NO: 1116 - DNA, 25 bp, Homo sapiens
tcctgaccatattaatgcccctgaa

SEQ ID NO: 1117 - DNA, 25 bp, Homo sapiens
cctgaccatattaatgcccctgaat

SEQ ID NO: 1118 - DNA, 25 bp, Homo sapiens
accatattaatgcccctgaatgacc

SEQ ID NO: 1119 - DNA, 25 bp, Homo sapiens
ccatattaatgcccctgaatgaccc

SEQ ID NO: 1120 - DNA, 25 bp, Homo sapiens
atattaatgcccctgaatgaccccc

SEQ ID NO: 1121 - DNA, 25 bp, Homo sapiens
tattaatgcccctgaatgacccccc

SEQ ID NO: 1122 - DNA, 25 bp, Homo sapiens
ttaatgcccctgaatgaccccccac

SEQ ID NO: 1123 - DNA, 25 bp, Homo sapiens
taatgcccctgaatgaccccccact

SEQ ID NO: 1124 - DNA, 25 bp, Homo sapiens
atgcccctgaatgaccccccactgt

SEQ ID NO: 1125 - DNA, 25 bp, Homo sapiens
tgcccctgaatgaccccccactgtt

SEQ ID NO: 1126 - DNA, 25 bp, Homo sapiens
gcccctgaatgaccccccactgttt

SEQ ID NO: 1127 - DNA, 25 bp, Homo sapiens
cctttgaagtaagtggctagaaaca

SEQ ID NO: 1128 - DNA, 25 bp, Homo sapiens
tggctagaaacagcactctggttat

SEQ ID NO: 1129 - DNA, 25 bp, Homo sapiens
tataattgccccagggcctgattca

SEQ ID NO: 1130 - DNA, 25 bp, Homo sapiens
cataaaactggaagctgcttcccct

SEQ ID NO: 1131 - DNA, 25 bp, Homo sapiens
gtgagcccctattattactttcaga

SEQ ID NO: 1132 - DNA, 25 bp, Homo sapiens
ttcagattgtctgtgacactcaagc

SEQ ID NO: 1133 - DNA, 25 bp, Homo sapiens
atgtggatccaagaaaccagggcca

SEQ ID NO: 1134 - DNA, 25 bp, Homo sapiens
atccaagaaaccagggccatgacca

SEQ ID NO: 1135 - DNA, 25 bp, Homo sapiens
caggtccactgtggagcagccatct

SEQ ID NO: 1136 - DNA, 25 bp, Homo sapiens
gagcagccatctatctacctgactc

SEQ ID NO: 1137 - DNA, 25 bp, Homo sapiens
gccatctatctacctgactcctgag

SEQ ID NO: 1138 - DNA, 25 bp, Homo sapiens
tatctacctgactcctgagccaggc

SEQ ID NO: 1139 - DNA, 25 bp, Homo sapiens
atctacctgactcctgagccaggct

SEQ ID NO: 1140 - DNA, 25 bp, Homo sapiens
gccaggctgccgtggtgtcatttct

SEQ ID NO: 1141 - DNA, 25 bp, Homo sapiens
ccgtgctctgtttccttttggagtt

SEQ ID NO: 1142 - DNA, 25 bp, Homo sapiens
tctccacattatctttgttcctggg

SEQ ID NO: 1143 - DNA, 25 bp, Homo sapiens
gtgatgtctagctgagtcttcatga

SEQ ID NO: 1144 - DNA, 25 bp, Homo sapiens
cctgattactacagaattccagaat

SEQ ID NO: 1145 - DNA, 25 bp, Homo sapiens
cctactattcagagacaacagtgac

SEQ ID NO: 1146 - DNA, 25 bp, Homo sapiens
gacctatgtgatgctggccttagtg

SEQ ID NO: 1147 - DNA, 25 bp, Homo sapiens
cctgaccacatgtggcgtggtttat

SEQ ID NO: 1148 - DNA, 25 bp, Homo sapiens
cgtggtttatccactctccaagaac

SEQ ID NO: 1149 - DNA, 25 bp, Homo sapiens
tctccaagaaccatctggtagttct

SEQ ID NO: 1150 - DNA, 25 bp, Homo sapiens
agttctggccattgccttcttcatg

SEQ ID NO: 1151 - DNA, 25 bp, Homo sapiens
atcatgctgcagctctacgcccaaa

SEQ ID NO: 1152 - DNA, 25 bp, Homo sapiens
ccatgcccagcagattgcccttcag

SEQ ID NO: 1153 - DNA, 25 bp, Homo sapiens
ccgcaagggcattgccacactggcc

SEQ ID NO: 1154 - DNA, 25 bp, Homo sapiens
tgcttggagcctttgccgcctgctg

SEQ ID NO: 1155 - DNA, 25 bp, Homo sapiens
ctggttgcccttcactgtctactgc

SEQ ID NO: 1156 - DNA, 25 bp, Homo sapiens
tgtctactgcctgctgggtgatgcc

SEQ ID NO: 1157 - DNA, 25 bp, Homo sapiens
ccttccgcaaccaggatgtgcagaa

SEQ ID NO: 1158 - DNA, 25 bp, Homo sapiens
gctgctgctgttcctcttccaagat

SEQ ID NO: 1159 - DNA, 25 bp, Homo sapiens
aatattccatccatatactttgggg

SEQ ID NO: 1160 - DNA, 25 bp, Homo sapiens
tactttggggacttgtagggatgcc

SEQ ID NO: 1161 - DNA, 25 bp, Homo sapiens
actttggggacttgtagggatgcct

SEQ ID NO: 1162 - DNA, 25 bp, Homo sapiens
tgtagggatgcctttctagtcctat

SEQ ID NO: 1163 - DNA, 25 bp, Homo sapiens
ggatgcctttctagtcctattctat

SEQ ID NO: 1164 - DNA, 25 bp, Homo sapiens
tagtcctattctattgcagttatag

SEQ ID NO: 1165 - DNA, 25 bp, Homo sapiens
ccaagggaaacactcggctttctat

SEQ ID NO: 1166 - DNA, 25 bp, Homo sapiens
ctcggctttctatagaaaattgcac

SEQ ID NO: 1167 - DNA, 25 bp, Homo sapiens
aaattgcactttttgtcgagtaatc

SEQ ID NO: 1168 - DNA, 25 bp, Homo sapiens
ctggtagatgtcacccagtggtttt

SEQ ID NO: 1169 - DNA, 25 bp, Homo sapiens
tcaaatgttcctgtatagtttttgc

SEQ ID NO: 1170 - DNA, 25 bp, Homo sapiens
tgctctattgtagcatttcttgatg

SEQ ID NO: 1171 - DNA, 25 bp, Homo sapiens
ctattgtagcatttcttgatgttgc

SEQ ID NO: 1172 - DNA, 25 bp, Homo sapiens
gcatttcttgatgttgcttagtcac

SEQ ID NO: 1173 - DNA, 25 bp, Homo sapiens
catttcttgatgttgcttagtcact

SEQ ID NO: 1174 - DNA, 25 bp, Homo sapiens
gatgttgcttagtcacttatttcat

SEQ ID NO: 1175 - DNA, 25 bp, Homo sapiens
gtgaaggaccctggagccctatcca

SEQ ID NO: 1176 - DNA, 25 bp, Homo sapiens
ggtctgctggccatcctgaccttgg

SEQ ID NO: 1177 - DNA, 25 bp, Homo sapiens
gtctgctggccatcctgaccttggc

SEQ ID NO: 1178 - DNA, 25 bp, Homo sapiens
cagtagccacactgtatggactatc

SEQ ID NO: 1179 - DNA, 25 bp, Homo sapiens
agccacactgtatggactatccctg

SEQ ID NO: 1180 - DNA, 25 bp, Homo sapiens
ccacactgtatggactatccctggc

SEQ ID NO: 1181 - DNA, 25 bp, Homo sapiens
atccctggccacacctggggagtag

SEQ ID NO: 1182 - DNA, 25 bp, Homo sapiens
ccctggccacacctggggagtaggc

SEQ ID NO: 1183 - DNA, 25 bp, Homo sapiens
ccacacctggggagtaggccaagaa

SEQ ID NO: 1184 - DNA, 25 bp, Homo sapiens
gagcgagcaagcagcccctcagaac

SEQ ID NO: 1185 - DNA, 25 bp, Homo sapiens
ctaggcagcatctacactcgcctgt

SEQ ID NO: 1186 - DNA, 25 bp, Homo sapiens
tacactcgcctgtatgggcagtccc

SEQ ID NO: 1187 - DNA, 25 bp, Homo sapiens
agtggagaccacaggccctgctgcg

SEQ ID NO: 1188 - DNA, 25 bp, Homo sapiens
tgggtggatgctcacgccaggcctt

SEQ ID NO: 1189 - DNA, 25 bp, Homo sapiens
agaccatctgctgtcacaaccactg

SEQ ID NO: 1190 - DNA, 25 bp, Homo sapiens
acctggccacaaccaggaacactag

SEQ ID NO: 1191 - DNA, 25 bp, Homo sapiens
tgcgtagtacagtgccaccgctgcc

SEQ ID NO: 1192 - DNA, 25 bp, Homo sapiens
gcgtagtacagtgccaccgctgccg

SEQ ID NO: 1193 - DNA, 25 bp, Homo sapiens
cgtagtacagtgccaccgctgccgt

SEQ ID NO: 1194 - DNA, 25 bp, Homo sapiens
gtagtacagtgccaccgctgccgtg

SEQ ID NO: 1195 - DNA, 25 bp, Homo sapiens
tagtacagtgccaccgctgccgtgt

SEQ ID NO: 1196 - DNA, 25 bp, Homo sapiens
agtacagtgccaccgctgccgtgtg

SEQ ID NO: 1197 - DNA, 25 bp, Homo sapiens
gtacagtgccaccgctgccgtgtgc

SEQ ID NO: 1198 - DNA, 25 bp, Homo sapiens
tacagtgccaccgctgccgtgtgcg

SEQ ID NO: 1199 - DNA, 25 bp, Homo sapiens
acagtgccaccgctgccgtgtgcgc

SEQ ID NO: 1200 - DNA, 25 bp, Homo sapiens
cagtgccaccgctgccgtgtgcgca

SEQ ID NO: 1201 - DNA, 25 bp, Homo sapiens
agtgccaccgctgccgtgtgcgcaa

SEQ ID NO: 1202 - DNA, 25 bp, Homo sapiens
catcgacgtctatggaattaagtgc

SEQ ID NO: 1203 - DNA, 25 bp, Homo sapiens
ttaagtgccatgaaaactcgcctag

SEQ ID NO: 1204 - DNA, 25 bp, Homo sapiens
tgaaaactcgcctaggaaggaggtg

SEQ ID NO: 1205 - DNA, 25 bp, Homo sapiens
ctcgcctaggaaggaggtgtacttc

SEQ ID NO: 1206 - DNA, 25 bp, Homo sapiens
aacccagaacagtattcaaagcgct

SEQ ID NO: 1207 - DNA, 25 bp, Homo sapiens
agcgctttttggactttattggcca

SEQ ID NO: 1208 - DNA, 25 bp, Homo sapiens
tggccacatcttgacgtaacctcct

SEQ ID NO: 1209 - DNA, 25 bp, Homo sapiens
atgaaaaccaaactcagtgaagtac

SEQ ID NO: 1210 - DNA, 25 bp, Homo sapiens
tcagtgaagtactcatcttgcagga

SEQ ID NO: 1211 - DNA, 25 bp, Homo sapiens
cagtgaagtactcatcttgcaggaa

SEQ ID NO: 1212 - DNA, 25 bp, Homo sapiens
actcatcttgcaggaagcaaacctc

SEQ ID NO: 1213 - DNA, 25 bp, Homo sapiens
caggaagcaaacctccttgtttaca

SEQ ID NO: 1214 - DNA, 25 bp, Homo sapiens
ttgtttacatcttcaggccaagatg

SEQ ID NO: 1215 - DNA, 25 bp, Homo sapiens
atcttcaggccaagatgactgattt

SEQ ID NO: 1216 - DNA, 25 bp, Homo sapiens
cttcaggccaagatgactgatttgg

SEQ ID NO: 1217 - DNA, 25 bp, Homo sapiens
agatgactgatttgggggctactcg

SEQ ID NO: 1218 - DNA, 25 bp, Homo sapiens
gtcatgaacaatgtcacctgtactc

SEQ ID NO: 1219 - DNA, 25 bp, Homo sapiens
ctgtactcggatctatgaaaaagta

SEQ ID NO: 1220 - DNA, 25 bp, Homo sapiens
aaattccatcatcactttggacagg

SEQ ID NO: 1221 - DNA, 25 bp, Homo sapiens
aattccatcatcactttggacagga

SEQ ID NO: 1222 - DNA, 25 bp, Homo sapiens
agaatgaccaagctcagttcaatga

SEQ ID NO: 1223 - DNA, 25 bp, Homo sapiens
accaagctcagttcaatgagcaaat

SEQ ID NO: 1224 - DNA, 25 bp, Homo sapiens
gttcaatgagcaaatctccatactg

SEQ ID NO: 1225 - DNA, 25 bp, Homo sapiens
ttttacatgcagctatttcaaagtg

SEQ ID NO: 1226 - DNA, 25 bp, Homo sapiens
taggatcatccctttggttaataaa

SEQ ID NO: 1227 - DNA, 25 bp, Homo sapiens
tattgagatgacactctagcaattt

SEQ ID NO: 1228 - DNA, 25 bp, Homo sapiens
ttgagatgacactctagcaatttat

SEQ ID NO: 1229 - DNA, 25 bp, Homo sapiens
tgagatgacactctagcaatttata

SEQ ID NO: 1230 - DNA, 25 bp, Homo sapiens
atagatagctactcttacaggaaat

SEQ ID NO: 1231 - DNA, 25 bp, Homo sapiens
gatagctactcttacaggaaatact

SEQ ID NO: 1232 - DNA, 25 bp, Homo sapiens
gctactcttacaggaaatactgtac

SEQ ID NO: 1233 - DNA, 25 bp, Homo sapiens
agaccattctcaataaaaggtgact

SEQ ID NO: 1234 - DNA, 25 bp, Homo sapiens
tttcttcttctctgggcgccaggtg

SEQ ID NO: 1235 - DNA, 25 bp, Homo sapiens
ccagcgaggtggaccggatgttccc

SEQ ID NO: 1236 - DNA, 25 bp, Homo sapiens
cccggggtgcctttggacacgcacg

SEQ ID NO: 1237 - DNA, 25 bp, Homo sapiens
cacgacgtcttccagtaccgagaga

SEQ ID NO: 1238 - DNA, 25 bp, Homo sapiens
tccagtaccgagagaaagcctattt

SEQ ID NO: 1239 - DNA, 25 bp, Homo sapiens
cagtaccgagagaaagcctatttct

SEQ ID NO: 1240 - DNA, 25 bp, Homo sapiens
agagaaagcctatttctgccaggac

SEQ ID NO: 1241 - DNA, 25 bp, Homo sapiens
tatttctgccaggaccgcttctact

SEQ ID NO: 1242 - DNA, 25 bp, Homo sapiens
ctactggcgcgtgagttcccggagt

SEQ ID NO: 1243 - DNA, 25 bp, Homo sapiens
gtgagttcccggagtgagttgaacc

SEQ ID NO: 1244 - DNA, 25 bp, Homo sapiens
tgagttcccggagtgagttgaacca

SEQ ID NO: 1245 - DNA, 25 bp, Homo sapiens
tgagttgaaccaggtggaccaagtg

SEQ ID NO: 1246 - DNA, 25 bp, Homo sapiens
ttgaaccaggtggaccaagtgggct

SEQ ID NO: 1247 - DNA, 25 bp, Homo sapiens
gaccaagtgggctacgtgacctatg

SEQ ID NO: 1248 - DNA, 25 bp, Homo sapiens
accaagtgggctacgtgacctatga

SEQ ID NO: 1249 - DNA, 25 bp, Homo sapiens
gtgggctacgtgacctatgacatcc

SEQ ID NO: 1250 - DNA, 25 bp, Homo sapiens
agataaacagtaactcagcgtaagt

SEQ ID NO: 1251 - DNA, 25 bp, Homo sapiens
cgtaagtgacctgtggatcatcagt

SEQ ID NO: 1252 - DNA, 25 bp, Homo sapiens
tgacctgtggatcatcagtagtacc

SEQ ID NO: 1253 - DNA, 25 bp, Homo sapiens
gacctgtggatcatcagtagtaccc

SEQ ID NO: 1254 - DNA, 25 bp, Homo sapiens
gctttagtttatctcagtcctggat

SEQ ID NO: 1255 - DNA, 25 bp, Homo sapiens
tagtttatctcagtcctggatggga

SEQ ID NO: 1256 - DNA, 25 bp, Homo sapiens
atctcagtcctggatgggagagaga

SEQ ID NO: 1257 - DNA, 25 bp, Homo sapiens
caaagagccctggatcgttgaattg

SEQ ID NO: 1258 - DNA, 25 bp, Homo sapiens
ccctggatcgttgaattgatagttt

SEQ ID NO: 1259 - DNA, 25 bp, Homo sapiens
ttgttcctgttcatagatgggaagc

SEQ ID NO: 1260 - DNA, 25 bp, Homo sapiens
gttcctgttcatagatgggaagctt

SEQ ID NO: 1261 - DNA, 25 bp, Homo sapiens
agatgggaagcttccttataactga

SEQ ID NO: 1262 - DNA, 25 bp, Homo sapiens
gaagcttccttataactgatgcaga

SEQ ID NO: 1263 - DNA, 25 bp, Homo sapiens
tccttataactgatgcagagaaaaa

SEQ ID NO: 1264 - DNA, 25 bp, Homo sapiens
ccttataactgatgcagagaaaaat

SEQ ID NO: 1265 - DNA, 25 bp, Homo sapiens
agttatgacatctgtcctaattagt

SEQ ID NO: 1266 - DNA, 25 bp, Homo sapiens
cctctctgtcccttggcaaatggac

SEQ ID NO: 1267 - DNA, 25 bp, Homo sapiens
ctgtcccttggcaaatggacaccag

SEQ ID NO: 1268 - DNA, 25 bp, Homo sapiens
tcccttggcaaatggacaccagggg

SEQ ID NO: 1269 - DNA, 25 bp, Homo sapiens
ggcaaatggacaccaggggcttctc

SEQ ID NO: 1270 - DNA, 25 bp, Homo sapiens
caaatggacaccaggggcttctccc

SEQ ID NO: 1271 - DNA, 25 bp, Homo sapiens
ccagccaggggcatggacagagcct

SEQ ID NO: 1272 - DNA, 25 bp, Homo sapiens
cagccaggggcatggacagagcctt

SEQ ID NO: 1273 - DNA, 25 bp, Homo sapiens
atggacagagcctttttctaaagaa

SEQ ID NO: 1274 - DNA, 25 bp, Homo sapiens
tggacagagcctttttctaaagaaa

SEQ ID NO: 1275 - DNA, 25 bp, Homo sapiens
tgacggcagccgtgcggacctaccg

SEQ ID NO: 1276 - DNA, 25 bp, Homo sapiens
agccgtgcggacctaccgctggcag

SEQ ID NO: 1277 - DNA, 25 bp, Homo sapiens
cggacctaccgctggcagtgcatcg

SEQ ID NO: 1278 - DNA, 25 bp, Homo sapiens
atcgagtgcaaatcctgcagcctgt

SEQ ID NO: 1279 - DNA, 25 bp, Homo sapiens
cagcctgtgcggaacctccgagaac

SEQ ID NO: 1280 - DNA, 25 bp, Homo sapiens
aacctccgagaacgacggtgccagc

SEQ ID NO: 1281 - DNA, 25 bp, Homo sapiens
cctccgagaacgacggtgccagctg

SEQ ID NO: 1282 - DNA, 25 bp, Homo sapiens
ggagggactcatcatttccatttac

SEQ ID NO: 1283 - DNA, 25 bp, Homo sapiens
gagggactcatcatttccatttacc

SEQ ID NO: 1284 - DNA, 25 bp, Homo sapiens
ctcttcttttcaagttgggtgatat

SEQ ID NO: 1285 - DNA, 25 bp, Homo sapiens
ttattgcagcgattaataacaggca

SEQ ID NO: 1286 - DNA, 25 bp, Homo sapiens
tttgttcttcatctaagccttctgg

SEQ ID NO: 1287 - DNA, 25 bp, Homo sapiens
gttcttcatctaagccttctggttt

SEQ ID NO: 1288 - DNA, 25 bp, Homo sapiens
catctaagccttctggttttatggg

SEQ ID NO: 1289 - DNA, 25 bp, Homo sapiens
cttctggttttatgggtcagagttc

SEQ ID NO: 1290 - DNA, 25 bp, Homo sapiens
ttttatgggtcagagttccgactgc

SEQ ID NO: 1291 - DNA, 25 bp, Homo sapiens
gtcagagttccgactgccatcttgg

SEQ ID NO: 1292 - DNA, 25 bp, Homo sapiens
gttccgactgccatcttggacttgt

SEQ ID NO: 1293 - DNA, 25 bp, Homo sapiens
actgccatcttggacttgtcagcaa

SEQ ID NO: 1294 - DNA, 25 bp, Homo sapiens
ccatcttggacttgtcagcaaaaaa

SEQ ID NO: 1295 - DNA, 25 bp, Homo sapiens
cgagaaggcccttaactcaaagtag

SEQ ID NO: 1296 - DNA, 25 bp, Homo sapiens
ggaccccttatttatcatgcctttg

SEQ ID NO: 1297 - DNA, 25 bp, Homo sapiens
aaatgtgcccactgtgtgcttttga

SEQ ID NO: 1298 - DNA, 25 bp, Homo sapiens
cctggcatttccatttctaaagatg

SEQ ID NO: 1299 - DNA, 25 bp, Homo sapiens
acatggctgcccagcctacgtgagc

SEQ ID NO: 1300 - DNA, 25 bp, Homo sapiens
ctacgtgagccctgagatcctcaac

SEQ ID NO: 1301 - DNA, 25 bp, Homo sapiens
caccactgggacctactccggaaag

SEQ ID NO: 1302 - DNA, 25 bp, Homo sapiens
cctactccggaaaggctgcggacgt

SEQ ID NO: 1303 - DNA, 25 bp, Homo sapiens
gggtgatgctctacacccttctggt

SEQ ID NO: 1304 - DNA, 25 bp, Homo sapiens
tgctctacacccttctggttggacg

SEQ ID NO: 1305 - DNA, 25 bp, Homo sapiens
tacacccttctggttggacgatacc

SEQ ID NO: 1306 - DNA, 25 bp, Homo sapiens
cagtgcccttttctccaaaattcgg

SEQ ID NO: 1307 - DNA, 25 bp, Homo sapiens
aaattcggcgtggacagttctgcat

SEQ ID NO: 1308 - DNA, 25 bp, Homo sapiens
gacagttctgcattcctgagcacat

SEQ ID NO: 1309 - DNA, 25 bp, Homo sapiens
gttctgcattcctgagcacatttcc

SEQ ID NO: 1310 - DNA, 25 bp, Homo sapiens
agacgggagccctccgagagactca

SEQ ID NO: 1311 - DNA, 25 bp, Homo sapiens
cgagatcctactgcacccctggttt

SEQ ID NO: 1312 - DNA, 25 bp, Homo sapiens
cacccctggtttgagtccgtcttgg

SEQ ID NO: 1313 - DNA, 25 bp, Homo sapiens
aataggaacttcagaccagattgtt

SEQ ID NO: 1314 - DNA, 25 bp, Homo sapiens
ctaccagtggaagatgctcaacacc

SEQ ID NO: 1315 - DNA, 25 bp, Homo sapiens
aaggcgaagaccagtactatctgcg

SEQ ID NO: 1316 - DNA, 25 bp, Homo sapiens
tctgcgggtcaccacggtggcttcc

SEQ ID NO: 1317 - DNA, 25 bp, Homo sapiens
tgaggtggtcgtgaagctctttgac

SEQ ID NO: 1318 - DNA, 25 bp, Homo sapiens
ggtcgtgaagctctttgactctgat

SEQ ID NO: 1319 - DNA, 25 bp, Homo sapiens
gaagctctttgactctgatcccatc

SEQ ID NO: 1320 - DNA, 25 bp, Homo sapiens
ctttgactctgatcccatcactgtg

SEQ ID NO: 1321 - DNA, 25 bp, Homo sapiens
agatgtggatgttgcttttgcacct

SEQ ID NO: 1322 - DNA, 25 bp, Homo sapiens
ccagagagagctctgcacgtcacca

SEQ ID NO: 1323 - DNA, 25 bp, Homo sapiens
agagagctctgcacgtcaccaagta

SEQ ID NO: 1324 - DNA, 25 bp, Homo sapiens
ctctgcacgtcaccaagtaaccagg

SEQ ID NO: 1325 - DNA, 25 bp, Homo sapiens
ggatcctgcactctaacactcgact

SEQ ID NO: 1326 - DNA, 25 bp, Homo sapiens
tgcactctaacactcgactctgctg

SEQ ID NO: 1327 - DNA, 25 bp, Homo sapiens
ctaacactcgactctgctgctcatg

SEQ ID NO: 1328 - DNA, 25 bp, Homo sapiens
taacactcgactctgctgctcatgg

SEQ ID NO: 1329 - DNA, 25 bp, Homo sapiens
aacactcgactctgctgctcatggg

SEQ ID NO: 1330 - DNA, 25 bp, Homo sapiens
ctgacttttgttaaattcagtaatg

SEQ ID NO: 1331 - DNA, 25 bp, Homo sapiens
tttaaaaacctgtatctgacccact

SEQ ID NO: 1332 - DNA, 25 bp, Homo sapiens
tccattctgtagacttttgaaaaaa

SEQ ID NO: 1333 - DNA, 25 bp, Homo sapiens
agtttttaatttgatgcccaatata

SEQ ID NO: 1334 - DNA, 25 bp, Homo sapiens
tattctgaccgttaaaaaattcttg

SEQ ID NO: 1335 - DNA, 25 bp, Homo sapiens
ttaaaaaattcttgttcatatggga

SEQ ID NO: 1336 - DNA, 25 bp, Homo sapiens
tcatatgggagaagggggagtaatg

SEQ ID NO: 1337 - DNA, 25 bp, Homo sapiens
gtaatgacttgtacaaacagtattt

SEQ ID NO: 1338 - DNA, 25 bp, Homo sapiens
ttgtacaaacagtatttctggtgta

SEQ ID NO: 1339 - DNA, 25 bp, Homo sapiens
ctttttattttgcactctgtaattg

SEQ ID NO: 1340 - DNA, 25 bp, Homo sapiens
attttgcactctgtaattgcacttt

SEQ ID NO: 1341 - DNA, 25 bp, Homo sapiens
ttgcactctgtaattgcacttttta

SEQ ID NO: 1342 - DNA, 25 bp, Homo sapiens
cactctgtaattgcactttttaagt

SEQ ID NO: 1343 - DNA, 25 bp, Homo sapiens
aattgcactttttaagtttgaagag

SEQ ID NO: 1344 - DNA, 25 bp, Homo sapiens
attgcactttttaagtttgaagagc

SEQ ID NO: 1345 - DNA, 25 bp, Homo sapiens
gtttgaagagccattttggtaaacg

SEQ ID NO: 1346 - DNA, 25 bp, Homo sapiens
tcacttggcgaggagcccgcctgct

SEQ ID NO: 1347 - DNA, 25 bp, Homo sapiens
cctcctgcagttcaccttgatcatg

SEQ ID NO: 1348 - DNA, 25 bp, Homo sapiens
agttcaccttgatcatgatggcctt

SEQ ID NO: 1349 - DNA, 25 bp, Homo sapiens
tcatgatggccttctacacgggact

SEQ ID NO: 1350 - DNA, 25 bp, Homo sapiens
ccagtgatgttctggcaggatttgc

SEQ ID NO: 1351 - DNA, 25 bp, Homo sapiens
atgttctggcaggatttgctcaagg

SEQ ID NO: 1352 - DNA, 25 bp, Homo sapiens
tggcaggatttgctcaaggagccct

SEQ ID NO: 1353 - DNA, 25 bp, Homo sapiens
ctcaaggagccctggtggcctgctg

SEQ ID NO: 1354 - DNA, 25 bp, Homo sapiens
tggtggcctgctgcatagttttctt

SEQ ID NO: 1355 - DNA, 25 bp, Homo sapiens
aagactaagacgacgctctccctgc

SEQ ID NO: 1356 - DNA, 25 bp, Homo sapiens
ctgcccctgctatccggaaggaaat

SEQ ID NO: 1357 - DNA, 25 bp, Homo sapiens
ccacaacatgatgtaggtgccaccc

SEQ ID NO: 1358 - DNA, 25 bp, Homo sapiens
cacctcctgagctgtttttgtaaaa

SEQ ID NO: 1359 - DNA, 25 bp, Homo sapiens
cagcaagttcttgctgctctccaat

SEQ ID NO: 1360 - DNA, 25 bp, Homo sapiens
agcaagttcttgctgctctccaatc

SEQ ID NO: 1361 - DNA, 25 bp, Homo sapiens
aaatgttttactatgtggccttcca

SEQ ID NO: 1362 - DNA, 25 bp, Homo sapiens
cctggccatgagcctgtctccgacc

SEQ ID NO: 1363 - DNA, 25 bp, Homo sapiens
ccatgagcctgtctccgaccctgaa

SEQ ID NO: 1364 - DNA, 25 bp, Homo sapiens
gagcctgtctccgaccctgaagggc

SEQ ID NO: 1365 - DNA, 25 bp, Homo sapiens
gcctgtctccgaccctgaagggcag

SEQ ID NO: 1366 - DNA, 25 bp, Homo sapiens
cctgtctccgaccctgaagggcagg

SEQ ID NO: 1367 - DNA, 25 bp, Homo sapiens
ctgtctccgaccctgaagggcaggc

SEQ ID NO: 1368 - DNA, 25 bp, Homo sapiens
tccgaccctgaagggcaggctgttg

SEQ ID NO: 1369 - DNA, 25 bp, Homo sapiens
ccgaccctgaagggcaggctgttgc

SEQ ID NO: 1370 - DNA, 25 bp, Homo sapiens
cgaccctgaagggcaggctgttgct

SEQ ID NO: 1371 - DNA, 25 bp, Homo sapiens
gaccctgaagggcaggctgttgctg

SEQ ID NO: 1372 - DNA, 25 bp, Homo sapiens
agggcaggctgttgctgatgaggcc

SEQ ID NO: 1373 - DNA, 25 bp, Homo sapiens
gggcaggctgttgctgatgaggccc

SEQ ID NO: 1374 - DNA, 25 bp, Homo sapiens
ggcaggctgttgctgatgaggccca

SEQ ID NO: 1375 - DNA, 25 bp, Homo sapiens
aggctgttgctgatgaggcccaagg

SEQ ID NO: 1376 - DNA, 25 bp, Homo sapiens
ggctgttgctgatgaggcccaaggc

SEQ ID NO: 1377 - DNA, 25 bp, Homo sapiens
tgttgctgatgaggcccaaggcagg

SEQ ID NO: 1378 - DNA, 25 bp, Homo sapiens
catagctaccgtgagttctcagcag

SEQ ID NO: 1379 - DNA, 25 bp, Homo sapiens
aattagccacgtaacaagagtctat

SEQ ID NO: 1380 - DNA, 25 bp, Homo sapiens
aacttgaaattgtgccacatgactt

SEQ ID NO: 1381 - DNA, 25 bp, Homo sapiens
aattacctgtgtgcagctattttaa

SEQ ID NO: 1382 - DNA, 25 bp, Homo sapiens
cattgtttcatgctatactttgtgg

SEQ ID NO: 1383 - DNA, 25 bp, Homo sapiens
catgctatactttgtgggataaaac

SEQ ID NO: 1384 - DNA, 25 bp, Homo sapiens
ttgcttttaaaacgtggacataact

SEQ ID NO: 1385 - DNA, 25 bp, Homo sapiens
tgcttttaaaacgtggacataactc

SEQ ID NO: 1386 - DNA, 25 bp, Homo sapiens
gcttttaaaacgtggacataactca

SEQ ID NO: 1387 - DNA, 25 bp, Homo sapiens
cgtggacataactcatttttctagt

SEQ ID NO: 1388 - DNA, 25 bp, Homo sapiens
tttagtgtctagtctgcagagagct

SEQ ID NO: 1389 - DNA, 25 bp, Homo sapiens
ttagtgtctagtctgcagagagctg

SEQ ID NO: 1390 - DNA, 25 bp, Homo sapiens
agtgtctagtctgcagagagctgtg

SEQ ID NO: 1391 - DNA, 25 bp, Homo sapiens
gtgtctagtctgcagagagctgtgt

SEQ ID NO: 1392 - DNA, 25 bp, Homo sapiens
gtctagtctgcagagagctgtgtga

SEQ ID NO: 1393 - DNA, 25 bp, Homo sapiens
tctagtctgcagagagctgtgtgat

SEQ ID NO: 1394 - DNA, 25 bp, Homo sapiens
gagccattcagaaaagacttccttt

SEQ ID NO: 1395 - DNA, 25 bp, Homo sapiens
agacttcctttgtgttcagcctata

SEQ ID NO: 1396 - DNA, 25 bp, Homo sapiens
gacttcctttgtgttcagcctatac

SEQ ID NO: 1397 - DNA, 25 bp, Homo sapiens
tcacactcccaagtcacttaaggtg

SEQ ID NO: 1398 - DNA, 25 bp, Homo sapiens
caaagcccaacaatgatctcaggaa

SEQ ID NO: 1399 - DNA, 25 bp, Homo sapiens
aaatgttttcatgtagcagcaatgc

SEQ ID NO: 1400 - DNA, 25 bp, Homo sapiens
aatgttttcatgtagcagcaatgca

SEQ ID NO: 1401 - DNA, 25 bp, Homo sapiens
ttcatgtagcagcaatgcagatttg

SEQ ID NO: 1402 - DNA, 25 bp, Homo sapiens
catgtagcagcaatgcagatttggt

SEQ ID NO: 1403 - DNA, 25 bp, Homo sapiens
gtatgtatttcactttatgactgac

SEQ ID NO: 1404 - DNA, 25 bp, Homo sapiens
tattgtttggccaaatagtaaacac

SEQ ID NO: 1405 - DNA, 25 bp, Homo sapiens
caccatgtgtttgctttgtgaaggt

SEQ ID NO: 1406 - DNA, 25 bp, Homo sapiens
agacaaacataactatttagcagag

SEQ ID NO: 1407 - DNA, 25 bp, Homo sapiens
gacaaacataactatttagcagaga

SEQ ID NO: 1408 - DNA, 25 bp, Homo sapiens
cagctggactgctgtacatcaagga

SEQ ID NO: 1409 - DNA, 25 bp, Homo sapiens
gctgtacatcaaggacagattaact

SEQ ID NO: 1410 - DNA, 25 bp, Homo sapiens
tctttggtcttctcgacaggtgccc

SEQ ID NO: 1411 - DNA, 25 bp, Homo sapiens
gtcttctcgacaggtgccctttctc

SEQ ID NO: 1412 - DNA, 25 bp, Homo sapiens
ccactgaatctgagaaagtactttc

SEQ ID NO: 1413 - DNA, 25 bp, Homo sapiens
tggaaaccaccttaaaacattagtg

SEQ ID NO: 1414 - DNA, 25 bp, Homo sapiens
caccttaaaacattagtgctatggt

SEQ ID NO: 1415 - DNA, 25 bp, Homo sapiens
accttaaaacattagtgctatggtt

SEQ ID NO: 1416 - DNA, 25 bp, Homo sapiens
gtgtatgtgccagtacttaccagtc

SEQ ID NO: 1417 - DNA, 25 bp, Homo sapiens
atgtgccagtacttaccagtcaatg

SEQ ID NO: 1418 - DNA, 25 bp, Homo sapiens
tgccagtacttaccagtcaatgcat

SEQ ID NO: 1419 - DNA, 25 bp, Homo sapiens
accagtcaatgcattgtggatatga

SEQ ID NO: 1420 - DNA, 25 bp, Homo sapiens
ggatatgagctttcgttgactgctt

SEQ ID NO: 1421 - DNA, 25 bp, Homo sapiens
tatgagctttcgttgactgcttctc

SEQ ID NO: 1422 - DNA, 25 bp, Homo sapiens
agctttcgttgactgcttctctgca

SEQ ID NO: 1423 - DNA, 25 bp, Homo sapiens
ttcgttgactgcttctctgcagtcg

SEQ ID NO: 1424 - DNA, 25 bp, Homo sapiens
ttgactgcttctctgcagtcgttga

SEQ ID NO: 1425 - DNA, 25 bp, Homo sapiens
ctctgcagtcgttgatgctaataaa

SEQ ID NO: 1426 - DNA, 25 bp, Homo sapiens
tctgaataaactaatacttaaaatg

SEQ ID NO: 1427 - DNA, 25 bp, Homo sapiens
atctgtacagcattagatttttata

SEQ ID NO: 1428 - DNA, 25 bp, Homo sapiens
ctgtacagcattagatttttatatt

SEQ ID NO: 1429 - DNA, 25 bp, Homo sapiens
ctgtttcccattgtcctcctactca

SEQ ID NO: 1430 - DNA, 25 bp, Homo sapiens
tttcccattgtcctcctactcaact

SEQ ID NO: 1431 - DNA, 25 bp, Homo sapiens
ttcccattgtcctcctactcaacta

SEQ ID NO: 1432 - DNA, 25 bp, Homo sapiens
tcccattgtcctcctactcaactaa

SEQ ID NO: 1433 - DNA, 25 bp, Homo sapiens
cattgtcctcctactcaactaaaat

SEQ ID NO: 1434 - DNA, 25 bp, Homo sapiens
gtcctcctactcaactaaaattcat

SEQ ID NO: 1435 - DNA, 25 bp, Homo sapiens
cctcctactcaactaaaattcatag

SEQ ID NO: 1436 - DNA, 25 bp, Homo sapiens
ctactcaactaaaattcatagttgg

SEQ ID NO: 1437 - DNA, 25 bp, Homo sapiens
ctcaactaaaattcatagttggctt

SEQ ID NO: 1438 - DNA, 25 bp, Homo sapiens
caactaaaattcatagttggcttta

SEQ ID NO: 1439 - DNA, 25 bp, Homo sapiens
taaaattcatagttggctttaagcc

SEQ ID NO: 1440 - DNA, 25 bp, Homo sapiens
taagcccaaaagaattttgaacaat

SEQ ID NO: 1441 - DNA, 25 bp, Homo sapiens
aattttgaacaatgtgacagaaaca

SEQ ID NO: 1442 - DNA, 25 bp, Homo sapiens
atgcagccctgcagggagaccctgc

SEQ ID NO: 1443 - DNA, 25 bp, Homo sapiens
tgccctccaagatgctggtgatagc

SEQ ID NO: 1444 - DNA, 25 bp, Homo sapiens
ccaagatgctggtgatagcagcaga

SEQ ID NO: 1445 - DNA, 25 bp, Homo sapiens
caagatgctggtgatagcagcagaa

SEQ ID NO: 1446 - DNA, 25 bp, Homo sapiens
gtactttatttgagggacaacagac

SEQ ID NO: 1447 - DNA, 25 bp, Homo sapiens
gggacaacagacttcacttccctga

SEQ ID NO: 1448 - DNA, 25 bp, Homo sapiens
ggacaacagacttcacttccctgaa

SEQ ID NO: 1449 - DNA, 25 bp, Homo sapiens
ccctgctgataccaccagacagaga

SEQ ID NO: 1450 - DNA, 25 bp, Homo sapiens
acactaggtgcctgcccagggagga

SEQ ID NO: 1451 - DNA, 25 bp, Homo sapiens
gaggactcgcgctacaagaggccac

SEQ ID NO: 1452 - DNA, 25 bp, Homo sapiens
ggactcgcgctacaagaggccactc

SEQ ID NO: 1453 - DNA, 25 bp, Homo sapiens
cagaggccaccttttgctccacgga

SEQ ID NO: 1454 - DNA, 25 bp, Homo sapiens
ggccaccttttgctccacggaggtg

SEQ ID NO: 1455 - DNA, 25 bp, Homo sapiens
ataagtcatctgtatgctgactggg

SEQ ID NO: 1456 - DNA, 25 bp, Homo sapiens
agtcatctgtatgctgactggggat

SEQ ID NO: 1457 - DNA, 25 bp, Homo sapiens
ataatggcatcaaatgtcagtcctt

SEQ ID NO: 1458 - DNA, 25 bp, Homo sapiens
agtctggtccccaaggctctggagc

SEQ ID NO: 1459 - DNA, 25 bp, Homo sapiens
ctggagccatacgtgacagaaatgg

SEQ ID NO: 1460 - DNA, 25 bp, Homo sapiens
ccatacgtgacagaaatggctcagg

SEQ ID NO: 1461 - DNA, 25 bp, Homo sapiens
ggaactgttggaggcgtgttcatca

SEQ ID NO: 1462 - DNA, 25 bp, Homo sapiens
tctaacggcacaaggttctctgcca

SEQ ID NO: 1463 - DNA, 25 bp, Homo sapiens
aggttctctgccagtgacctgacca

SEQ ID NO: 1464 - DNA, 25 bp, Homo sapiens
tctgccagtgacctgaccaacggtg

SEQ ID NO: 1465 - DNA, 25 bp, Homo sapiens
agtgacctgaccaacggtgcagatg

SEQ ID NO: 1466 - DNA, 25 bp, Homo sapiens
gggatgctggccacaagctccaatg

SEQ ID NO: 1467 - DNA, 25 bp, Homo sapiens
ctggccacaagctccaatgggtctc

SEQ ID NO: 1468 - DNA, 25 bp, Homo sapiens
gacgatgacttcaacgagaatgacg

SEQ ID NO: 1469 - DNA, 25 bp, Homo sapiens
gacttcaacgagaatgacgaggacg

SEQ ID NO: 1470 - DNA, 25 bp, Homo sapiens
tggcctagtcccaagaagatattgg

SEQ ID NO: 1471 - DNA, 25 bp, Homo sapiens
atttagatatgcacctctgataagc

SEQ ID NO: 1472 - DNA, 25 bp, Homo sapiens
atatgcacctctgataagcaaggat

SEQ ID NO: 1473 - DNA, 25 bp, Homo sapiens
tgctctgccgaagaccttaaaatgg

SEQ ID NO: 1474 - DNA, 25 bp, Homo sapiens
atgctgcgtcagttcacagggaacc

SEQ ID NO: 1475 - DNA, 25 bp, Homo sapiens
ctgcgtcagttcacagggaacccca

SEQ ID NO: 1476 - DNA, 25 bp, Homo sapiens
ttcacagggaaccccaacattccaa

SEQ ID NO: 1477 - DNA, 25 bp, Homo sapiens
aacattccaaaacctcggcgaatct

SEQ ID NO: 1478 - DNA, 25 bp, Homo sapiens
aaacctcggcgaatcttgcgctcgg

SEQ ID NO: 1479 - DNA, 25 bp, Homo sapiens
cctcggcgaatcttgcgctcggcct

SEQ ID NO: 1480 - DNA, 25 bp, Homo sapiens
atcttgcgctcggcctggggcagca

SEQ ID NO: 1481 - DNA, 25 bp, Homo sapiens
ttgcgctcggcctggggcagcaacc

SEQ ID NO: 1482 - DNA, 25 bp, Homo sapiens
tacacacaggtgggctccagcgggg

SEQ ID NO: 1483 - DNA, 25 bp, Homo sapiens
ccctgccgttacacagagagctcaa

SEQ ID NO: 1484 - DNA, 25 bp, Homo sapiens
cgttacacagagagctcaaagacag

SEQ ID NO: 1485 - DNA, 25 bp, Homo sapiens
cccatgcaggtgctgttttccggtg

SEQ ID NO: 1486 - DNA, 25 bp, Homo sapiens
atgcaggtgctgttttccggtgagg

SEQ ID NO: 1487 - DNA, 25 bp, Homo sapiens
gtgctgttttccggtgaggccaccc

SEQ ID NO: 1488 - DNA, 25 bp, Homo sapiens
cacggtgctctgctgtccggccagc

SEQ ID NO: 1489 - DNA, 25 bp, Homo sapiens
ggtgctctgctgtccggccagcgtg

SEQ ID NO: 1490 - DNA, 25 bp, Homo sapiens
cgtaccgagagataggcagaagact

SEQ ID NO: 1491 - DNA, 25 bp, Homo sapiens
ggaatgagactgatcctgagttcgt

SEQ ID NO: 1492 - DNA, 25 bp, Homo sapiens
gagactgatcctgagttcgtcattg

SEQ ID NO: 1493 - DNA, 25 bp, Homo sapiens
ataggatagggcactacagattccg

SEQ ID NO: 1494 - DNA, 25 bp, Homo sapiens
tccggtacagtgacaccctggagct

SEQ ID NO: 1495 - DNA, 25 bp, Homo sapiens
gtagtgacaggcttgtatggcaaac

SEQ ID NO: 1496 - DNA, 25 bp, Homo sapiens
gcttgtatggcaaacccttcctctc

SEQ ID NO: 1497 - DNA, 25 bp, Homo sapiens
ccttcctctctgcagatcggggtct

SEQ ID NO: 1498 - DNA, 25 bp, Homo sapiens
cctctctgcagatcggggtctggtg

SEQ ID NO: 1499 - DNA, 25 bp, Homo sapiens
gttgatgccaggagagaatatttcc

SEQ ID NO: 1500 - DNA, 25 bp, Homo sapiens
atcccatttgatagattttcactgg

SEQ ID NO: 1501 - DNA, 25 bp, Homo sapiens
cttctctttgggtcctgtggacctc

SEQ ID NO: 1502 - DNA, 25 bp, Homo sapiens
aacttgatccgcatggccgtggcag

SEQ ID NO: 1503 - DNA, 25 bp, Homo sapiens
tggcaggactggtcctcgtggctct

SEQ ID NO: 1504 - DNA, 25 bp, Homo sapiens
actgaacaaggaagcctcggcagat

SEQ ID NO: 1505 - DNA, 25 bp, Homo sapiens
caccaagtgtctgcaagtaaacacc

SEQ ID NO: 1506 - DNA, 25 bp, Homo sapiens
acattggacctttcctgaggaagag

SEQ ID NO: 1507 - DNA, 25 bp, Homo sapiens
aaagcagtggctccattggtgttga

SEQ ID NO: 1508 - DNA, 25 bp, Homo sapiens
cagtggctccattggtgttgacata

SEQ ID NO: 1509 - DNA, 25 bp, Homo sapiens
tggctccattggtgttgacatacat

SEQ ID NO: 1510 - DNA, 25 bp, Homo sapiens
tctggcctcagtgttacagctaaat

SEQ ID NO: 1511 - DNA, 25 bp, Homo sapiens
cagtatcaacattctaagatgctgg

SEQ ID NO: 1512 - DNA, 25 bp, Homo sapiens
caacattctaagatgctgggactta

SEQ ID NO: 1513 - DNA, 25 bp, Homo sapiens
atgctgggacttactgtgtcatcaa

SEQ ID NO: 1514 - DNA, 25 bp, Homo sapiens
ggacttactgtgtcatcaaatgtgc

SEQ ID NO: 1515 - DNA, 25 bp, Homo sapiens
gagagacctggctttggcaagagca

SEQ ID NO: 1516 - DNA, 25 bp, Homo sapiens
cctggctttggcaagagcagatgtc

SEQ ID NO: 1517 - DNA, 25 bp, Homo sapiens
acgtctctcctgatgtagcacttaa

SEQ ID NO: 1518 - DNA, 25 bp, Homo sapiens
ctcctgatgtagcacttaagcttca

SEQ ID NO: 1519 - DNA, 25 bp, Homo sapiens
atgtagcacttaagcttcatttagt

SEQ ID NO: 1520 - DNA, 25 bp, Homo sapiens
acacatttgcatccacatattaggg

SEQ ID NO: 1521 - DNA, 25 bp, Homo sapiens
ttgcatccacatattagggaaggaa

SEQ ID NO: 1522 - DNA, 25 bp, Homo sapiens
atctattttgatgcagcatttgata

SEQ ID NO: 1523 - DNA, 25 bp, Homo sapiens
acctcactctttatagtgcacaaaa

SEQ ID NO: 1524 - DNA, 25 bp, Homo sapiens
ttaccagcttttaaccatctgatat

SEQ ID NO: 1525 - DNA, 25 bp, Homo sapiens
gcttttaaccatctgatatctatag

SEQ ID NO: 1526 - DNA, 25 bp, Homo sapiens
gtagacacactatcatagttaacat

SEQ ID NO: 1527 - DNA, 25 bp, Homo sapiens
acactatcatagttaacatagttaa

SEQ ID NO: 1528 - DNA, 25 bp, Homo sapiens
tagttaagttcagcacttgtctcat

SEQ ID NO: 1529 - DNA, 25 bp, Homo sapiens
agttcagcacttgtctcattttaat

SEQ ID NO: 1530 - DNA, 25 bp, Homo sapiens
tgtaaagatttgcttccattttcct

SEQ ID NO: 1531 - DNA, 25 bp, Homo sapiens
cttccattttcctacaggcagtctc

SEQ ID NO: 1532 - DNA, 25 bp, Homo sapiens
cactgtgcaggtgctattgttactc

SEQ ID NO: 1533 - DNA, 25 bp, Homo sapiens
tttctagcctgcactttgatgtcat

SEQ ID NO: 1534 - DNA, 25 bp, Homo sapiens
gcctgcactttgatgtcatgtgttc

SEQ ID NO: 1535 - DNA, 25 bp, Homo sapiens
actttgatgtcatgtgttccctttg

SEQ ID NO: 1536 - DNA, 25 bp, Homo sapiens
tgtgttccctttgtctttcaaactc

SEQ ID NO: 1537 - DNA, 25 bp, Homo sapiens
tcttggagaccttacccctggctgt

SEQ ID NO: 1538 - DNA, 25 bp, Homo sapiens
aaagcaaaaagcaggccacaacctt

SEQ ID NO: 1539 - DNA, 25 bp, Homo sapiens
ggaagactaaccaagatttggacat

SEQ ID NO: 1540 - DNA, 25 bp, Homo sapiens
gaagactaaccaagatttggacatt

SEQ ID NO: 1541 - DNA, 25 bp, Homo sapiens
agactaaccaagatttggacattgg

SEQ ID NO: 1542 - DNA, 25 bp, Homo sapiens
gactaaccaagatttggacattgga

SEQ ID NO: 1543 - DNA, 25 bp, Homo sapiens
ctaaccaagatttggacattggaat

SEQ ID NO: 1544 - DNA, 25 bp, Homo sapiens
agaacctgggaattcctgcacggaa

SEQ ID NO: 1545 - DNA, 25 bp, Homo sapiens
aacctgggaattcctgcacggaaga

SEQ ID NO: 1546 - DNA, 25 bp, Homo sapiens
acctgggaattcctgcacggaagac

SEQ ID NO: 1547 - DNA, 25 bp, Homo sapiens
gggaattcctgcacggaagacaaga

SEQ ID NO: 1548 - DNA, 25 bp, Homo sapiens
attcctgcacggaagacaagagagt

SEQ ID NO: 1549 - DNA, 25 bp, Homo sapiens
ttcctgcacggaagacaagagagta

SEQ ID NO: 1550 - DNA, 25 bp, Homo sapiens
cctgcacggaagacaagagagtagc

SEQ ID NO: 1551 - DNA, 25 bp, Homo sapiens
tcttatgtgactctctttgaaaatg

SEQ ID NO: 1552 - DNA, 25 bp, Homo sapiens
cttatgtgactctctttgaaaatgt

SEQ ID NO: 1553 - DNA, 25 bp, Homo sapiens
tatgtgactctctttgaaaatgtgc

SEQ ID NO: 1554 - DNA, 25 bp, Homo sapiens
actggaactggcagagaaggctctg

SEQ ID NO: 1555 - DNA, 25 bp, Homo sapiens
aactggcagagaaggctctggcttc

SEQ ID NO: 1556 - DNA, 25 bp, Homo sapiens
gcagagaaggctctggcttccaaac

SEQ ID NO: 1557 - DNA, 25 bp, Homo sapiens
aagaggacctggaaaccatgaccat

SEQ ID NO: 1558 - DNA, 25 bp, Homo sapiens
agattcacgtgatggattgcatcat

SEQ ID NO: 1559 - DNA, 25 bp, Homo sapiens
gattcacgtgatggattgcatcatt

SEQ ID NO: 1560 - DNA, 25 bp, Homo sapiens
attcacgtgatggattgcatcattt

SEQ ID NO: 1561 - DNA, 25 bp, Homo sapiens
ttcacgtgatggattgcatcattta

SEQ ID NO: 1562 - DNA, 25 bp, Homo sapiens
tcacgtgatggattgcatcatttaa

SEQ ID NO: 1563 - DNA, 25 bp, Homo sapiens
catcatttaagtgttgatgtatcac

SEQ ID NO: 1564 - DNA, 25 bp, Homo sapiens
tccccaaaactgttggtaaatgtca

SEQ ID NO: 1565 - DNA, 25 bp, Homo sapiens
ccccaaaactgttggtaaatgtcag

SEQ ID NO: 1566 - DNA, 25 bp, Homo sapiens
cccaaaactgttggtaaatgtcaga

SEQ ID NO: 1567 - DNA, 25 bp, Homo sapiens
agtcccagccagagcccctagtggt

SEQ ID NO: 1568 - DNA, 25 bp, Homo sapiens
tcaccacgtcgctgtacagtgcctg

SEQ ID NO: 1569 - DNA, 25 bp, Homo sapiens
tctcatcagggaaggctctgtgatg

SEQ ID NO: 1570 - DNA, 25 bp, Homo sapiens
ggcgattgtagctctgacatctgga

SEQ ID NO: 1571 - DNA, 25 bp, Homo sapiens
tctgacatctggatttgaactccac

SEQ ID NO: 1572 - DNA, 25 bp, Homo sapiens
ctgacatctggatttgaactccacc

SEQ ID NO: 1573 - DNA, 25 bp, Homo sapiens
ggccctcacttccttggggacctgg

SEQ ID NO: 1574 - DNA, 25 bp, Homo sapiens
ctggcttcattctgctctctcttgg

SEQ ID NO: 1575 - DNA, 25 bp, Homo sapiens
gcttcattctgctctctcttggcac

SEQ ID NO: 1576 - DNA, 25 bp, Homo sapiens
ttactgaccactgttgcttgttgct

SEQ ID NO: 1577 - DNA, 25 bp, Homo sapiens
tactgaccactgttgcttgttgctc

SEQ ID NO: 1578 - DNA, 25 bp, Homo sapiens
ccactgttgcttgttgctcactgtg

SEQ ID NO: 1579 - DNA, 25 bp, Homo sapiens
ttgcttgttgctcactgtgctgctt

SEQ ID NO: 1580 - DNA, 25 bp, Homo sapiens
cactgtgctgcttttccatgagctc

SEQ ID NO: 1581 - DNA, 25 bp, Homo sapiens
tttccatgagctcttggaggcacca

SEQ ID NO: 1582 - DNA, 25 bp, Homo sapiens
cttggaggcaccaagaaataaactc

SEQ ID NO: 1583 - DNA, 25 bp, Homo sapiens
cagtgtaaagctgccctggatgagc

SEQ ID NO: 1584 - DNA, 25 bp, Homo sapiens
agtgtaaagctgccctggatgagca

SEQ ID NO: 1585 - DNA, 25 bp, Homo sapiens
gtgtaaagctgccctggatgagcag

SEQ ID NO: 1586 - DNA, 25 bp, Homo sapiens
tgtaaagctgccctggatgagcagt

SEQ ID NO: 1587 - DNA, 25 bp, Homo sapiens
gagcagtttgaacctcagaagactc

SEQ ID NO: 1588 - DNA, 25 bp, Homo sapiens
ggattcacacgctcagcagcgccca

SEQ ID NO: 1589 - DNA, 25 bp, Homo sapiens
gattcacacgctcagcagcgcccac

SEQ ID NO: 1590 - DNA, 25 bp, Homo sapiens
attcacacgctcagcagcgcccacc

SEQ ID NO: 1591 - DNA, 25 bp, Homo sapiens
tcacacgctcagcagcgcccaccat

SEQ ID NO: 1592 - DNA, 25 bp, Homo sapiens
cacacgctcagcagcgcccaccatt

SEQ ID NO: 1593 - DNA, 25 bp, Homo sapiens
acacgctcagcagcgcccaccattg

SEQ ID NO: 1594 - DNA, 25 bp, Homo sapiens
cacgctcagcagcgcccaccattga

SEQ ID NO: 1595 - DNA, 25 bp, Homo sapiens
acgctcagcagcgcccaccattgat

SEQ ID NO: 1596 - DNA, 25 bp, Homo sapiens
gctcagcagcgcccaccattgattg

SEQ ID NO: 1597 - DNA, 25 bp, Homo sapiens
agcagcgcccaccattgattgccaa

SEQ ID NO: 1598 - DNA, 25 bp, Homo sapiens
gcagcgcccaccattgattgccaat

SEQ ID NO: 1599 - DNA, 25 bp, Homo sapiens
ggccacagactcaacatgtgtgtgt

SEQ ID NO: 1600 - DNA, 25 bp, Homo sapiens
gggttccagcccaacatagagtaac

SEQ ID NO: 1601 - DNA, 25 bp, Homo sapiens
gcccaacatagagtaacattatttg

SEQ ID NO: 1602 - DNA, 25 bp, Homo sapiens
gtaacattatttgtacctcccaggc

SEQ ID NO: 1603 - DNA, 25 bp, Homo sapiens
ggagctgctgggatcctccttatct

SEQ ID NO: 1604 - DNA, 25 bp, Homo sapiens
gagctgctgggatcctccttatctt

SEQ ID NO: 1605 - DNA, 25 bp, Homo sapiens
ctgctgggatcctccttatcttgac

SEQ ID NO: 1606 - DNA, 25 bp, Homo sapiens
atcctccttatcttgactgggatgt

SEQ ID NO: 1607 - DNA, 25 bp, Homo sapiens
tccttatcttgactgggatgtccct

SEQ ID NO: 1608 - DNA, 25 bp, Homo sapiens
tcttgactgggatgtccctgtctcc

SEQ ID NO: 1609 - DNA, 25 bp, Homo sapiens
ttgactgggatgtccctgtctcccc

SEQ ID NO: 1610 - DNA, 25 bp, Homo sapiens
cccttgctccttgaacatggccaag

SEQ ID NO: 1611 - DNA, 25 bp, Homo sapiens
ccttgctccttgaacatggccaagg

SEQ ID NO: 1612 - DNA, 25 bp, Homo sapiens
ccccttgatgcctgggaataggttt

SEQ ID NO: 1613 - DNA, 25 bp, Homo sapiens
aggttttgccaataaacgtatctgt

SEQ ID NO: 1614 - DNA, 25 bp, Homo sapiens
ggttttgccaataaacgtatctgtg

SEQ ID NO: 1615 - DNA, 25 bp, Homo sapiens
ctcccgaggacctggagagcctgag

SEQ ID NO: 1616 - DNA, 25 bp, Homo sapiens
agcggcagctgcttttccgccagct

SEQ ID NO: 1617 - DNA, 25 bp, Homo sapiens
ggcagctgcttttccgccagctgca

SEQ ID NO: 1618 - DNA, 25 bp, Homo sapiens
tgcttttccgccagctgcagaagaa

SEQ ID NO: 1619 - DNA, 25 bp, Homo sapiens
gccagctgcagaagaactcgggctg

SEQ ID NO: 1620 - DNA, 25 bp, Homo sapiens
agggaccgcccagatcccagctttg

SEQ ID NO: 1621 - DNA, 25 bp, Homo sapiens
gggaccgcccagatcccagctttga

SEQ ID NO: 1622 - DNA, 25 bp, Homo sapiens
cgcccagatcccagctttgagagag

SEQ ID NO: 1623 - DNA, 25 bp, Homo sapiens
tcccagctttgagagaggagtgtgt

SEQ ID NO: 1624 - DNA, 25 bp, Homo sapiens
agtgtgtgtgcacgtattcatctgt

SEQ ID NO: 1625 - DNA, 25 bp, Homo sapiens
acatgtctgcatgtgtatatgttcg

SEQ ID NO: 1626 - DNA, 25 bp, Homo sapiens
catgtctgcatgtgtatatgttcgt

SEQ ID NO: 1627 - DNA, 25 bp, Homo sapiens
tctggattttaatcccaggcatccc

SEQ ID NO: 1628 - DNA, 25 bp, Homo sapiens
tgtgcagcggtctggttatcgtcta

SEQ ID NO: 1629 - DNA, 25 bp, Homo sapiens
ggttatcgtctatccccaggggaat

SEQ ID NO: 1630 - DNA, 25 bp, Homo sapiens
tcgtctatccccaggggaatccaca

SEQ ID NO: 1631 - DNA, 25 bp, Homo sapiens
gttaagttcagcacttgtctcattt

SEQ ID NO: 1632 - DNA, 25 bp, Homo sapiens
gttcagcacttgtctcattttaatg

SEQ ID NO: 1633 - DNA, 25 bp, Homo sapiens
gcacttgtctcattttaatgtaaag

SEQ ID NO: 1634 - DNA, 25 bp, Homo sapiens
agatttgcttccattttcctacagg

SEQ ID NO: 1635 - DNA, 25 bp, Homo sapiens
tttgcttccattttcctacaggcag

SEQ ID NO: 1636 - DNA, 25 bp, Homo sapiens
gcttccattttcctacaggcagtct

SEQ ID NO: 1637 - DNA, 25 bp, Homo sapiens
aggcagtctctctcttcctcacagt

SEQ ID NO: 1638 - DNA, 25 bp, Homo sapiens
ctcacagtcccactgtgcaggtgct

SEQ ID NO: 1639 - DNA, 25 bp, Homo sapiens
tcacagtcccactgtgcaggtgcta

SEQ ID NO: 1640 - DNA, 25 bp, Homo sapiens
gtcccactgtgcaggtgctattgtt

SEQ ID NO: 1641 - DNA, 25 bp, Homo sapiens
ctgtgcaggtgctattgttactctt

SEQ ID NO: 1642 - DNA, 25 bp, Homo sapiens
tgtgcaggtgctattgttactctta

SEQ ID NO: 1643 - DNA, 25 bp, Homo sapiens
gtgctattgttactcttacgaatat

SEQ ID NO: 1644 - DNA, 25 bp, Homo sapiens
tcttctaagtgaaatttctagcctg

SEQ ID NO: 1645 - DNA, 25 bp, Homo sapiens
taagtgaaatttctagcctgcactt

SEQ ID NO: 1646 - DNA, 25 bp, Homo sapiens
ctgcactttgatgtcatgtgttccc

SEQ ID NO: 1647 - DNA, 25 bp, Homo sapiens
gagaagttccattcaaagtgccaat

SEQ ID NO: 1648 - DNA, 25 bp, Homo sapiens
aagttccattcaaagtgccaatgat

SEQ ID NO: 1649 - DNA, 25 bp, Homo sapiens
agttccattcaaagtgccaatgata

SEQ ID NO: 1650 - DNA, 25 bp, Homo sapiens
gttccattcaaagtgccaatgatag

SEQ ID NO: 1651 - DNA, 25 bp, Homo sapiens
ttccattcaaagtgccaatgataga

SEQ ID NO: 1652 - DNA, 25 bp, Homo sapiens
attcaaagtgccaatgatagagtca

SEQ ID NO: 1653 - DNA, 25 bp, Homo sapiens
ttcaaagtgccaatgatagagtcaa

SEQ ID NO: 1654 - DNA, 25 bp, Homo sapiens
aacacaatcaggtgtggattggtgc

SEQ ID NO: 1655 - DNA, 25 bp, Homo sapiens
cacaatcaggtgtggattggtgcta

SEQ ID NO: 1656 - DNA, 25 bp, Homo sapiens
acaatcaggtgtggattggtgctac

SEQ ID NO: 1657 - DNA, 25 bp, Homo sapiens
caatcaggtgtggattggtgctact

SEQ ID NO: 1658 - DNA, 25 bp, Homo sapiens
ttggtgctactttgaacaaaaggtc

SEQ ID NO: 1659 - DNA, 25 bp, Homo sapiens
tggtgctactttgaacaaaaggtcc

SEQ ID NO: 1660 - DNA, 25 bp, Homo sapiens
tccccctgtggtcttttgttcaaca

SEQ ID NO: 1661 - DNA, 25 bp, Homo sapiens
ccccctgtggtcttttgttcaacat

SEQ ID NO: 1662 - DNA, 25 bp, Homo sapiens
ggtcttttgttcaacattgtacaat

SEQ ID NO: 1663 - DNA, 25 bp, Homo sapiens
tccccagggaagaccctgaccgtgt

SEQ ID NO: 1664 - DNA, 25 bp, Homo sapiens
agggaagaccctgaccgtgtacata

SEQ ID NO: 1665 - DNA, 25 bp, Homo sapiens
accctgaccgtgtacatagccctgg

SEQ ID NO: 1666 - DNA, 25 bp, Homo sapiens
cctgaccgtgtacatagccctggtg

SEQ ID NO: 1667 - DNA, 25 bp, Homo sapiens
ctgaccgtgtacatagccctggtgc

SEQ ID NO: 1668 - DNA, 25 bp, Homo sapiens
gaccgtgtacatagccctggtgctc

SEQ ID NO: 1669 - DNA, 25 bp, Homo sapiens
tgtacatagccctggtgctcctgcc

SEQ ID NO: 1670 - DNA, 25 bp, Homo sapiens
ggtgtgtctcggtgacgttttctat

SEQ ID NO: 1671 - DNA, 25 bp, Homo sapiens
gtgtgtctcggtgacgttttctatc

SEQ ID NO: 1672 - DNA, 25 bp, Homo sapiens
cgttttctatcagacgtgctccctc

SEQ ID NO: 1673 - DNA, 25 bp, Homo sapiens
tctcaactgcctcagcgatttcaag

SEQ ID NO: 1674 - DNA, 25 bp, Homo sapiens
ctcaactgcctcagcgatttcaaga

SEQ ID NO: 1675 - DNA, 25 bp, Homo sapiens
agtacaaggacagacagcaggcacg

SEQ ID NO: 1676 - DNA, 25 bp, Homo sapiens
ccgcagcctggcatctgtgcgtgtg

SEQ ID NO: 1677 - DNA, 25 bp, Homo sapiens
gcctggcatctgtgtgcgtggctat

SEQ ID NO: 1678 - DNA, 25 bp, Homo sapiens
atgtatatagtctttgcagaggtcc

SEQ ID NO: 1679 - DNA, 25 bp, Homo sapiens
gaggacccaggaaaggcaggattga

SEQ ID NO: 1680 - DNA, 25 bp, Homo sapiens
gccaagaagcagtggccttattgca

SEQ ID NO: 1681 - DNA, 25 bp, Homo sapiens
aagcagtggccttattgcatcccaa

SEQ ID NO: 1682 - DNA, 25 bp, Homo sapiens
tggccttattgcatcccaaaccacg

SEQ ID NO: 1683 - DNA, 25 bp, Homo sapiens
tattgcatcccaaaccacgcctctt

SEQ ID NO: 1684 - DNA, 25 bp, Homo sapiens
ggctgcctcccttgtggcagcaacg

SEQ ID NO: 1685 - DNA, 25 bp, Homo sapiens
agcaacggcacagctaattctactc

SEQ ID NO: 1686 - DNA, 25 bp, Homo sapiens
ggcacagctaattctactcacagtg

SEQ ID NO: 1687 - DNA, 25 bp, Homo sapiens
gctaattctactcacagtgctttta

SEQ ID NO: 1688 - DNA, 25 bp, Homo sapiens
atggttctggctgtttgagattctc

SEQ ID NO: 1689 - DNA, 25 bp, Homo sapiens
gtttgagattctcaaaggagcgagc

SEQ ID NO: 1690 - DNA, 25 bp, Homo sapiens
gattctcaaaggagcgagcatgtcg

SEQ ID NO: 1691 - DNA, 25 bp, Homo sapiens
caaaggagcgagcatgtcgtggaca

SEQ ID NO: 1692 - DNA, 25 bp, Homo sapiens
agcgagcatgtcgtggacacacaca

SEQ ID NO: 1693 - DNA, 25 bp, Homo sapiens
gtggacacacacagactatttttag

SEQ ID NO: 1694 - DNA, 25 bp, Homo sapiens
gaaacaaccatgtcatttcagaagt

SEQ ID NO: 1695 - DNA, 25 bp, Homo sapiens
tgtcagggggacctgggcattctct

SEQ ID NO: 1696 - DNA, 25 bp, Homo sapiens
ggacctgggcattctctggggccct

SEQ ID NO: 1697 - DNA, 25 bp, Homo sapiens
gacctgggcattctctggggccctc

SEQ ID NO: 1698 - DNA, 25 bp, Homo sapiens
tctctggggccctcctttgacatat

SEQ ID NO: 1699 - DNA, 25 bp, Homo sapiens
ctctggggccctcctttgacatata

SEQ ID NO: 1700 - DNA, 25 bp, Homo sapiens
tctggggccctcctttgacatatac

SEQ ID NO: 1701 - DNA, 25 bp, Homo sapiens
ctggggccctcctttgacatatacc

SEQ ID NO: 1702 - DNA, 25 bp, Homo sapiens
tggggccctcctttgacatataccc

SEQ ID NO: 1703 - DNA, 25 bp, Homo sapiens
ggggccctcctttgacatataccca

SEQ ID NO: 1704 - DNA, 25 bp, Homo sapiens
gggccctcctttgacatatacccag

SEQ ID NO: 1705 - DNA, 25 bp, Homo sapiens
cctcctttgacatatacccagcgag

SEQ ID NO: 1706 - DNA, 25 bp, Homo sapiens
ctcctttgacatatacccagcgagc

SEQ ID NO: 1707 - DNA, 25 bp, Homo sapiens
tcctttgacatatacccagcgagca

SEQ ID NO: 1708 - DNA, 25 bp, Homo sapiens
cctttgacatatacccagcgagcac

SEQ ID NO: 1709 - DNA, 25 bp, Homo sapiens
tgacatatacccagcgagcactttg

SEQ ID NO: 1710 - DNA, 25 bp, Homo sapiens
cggatcatggtgataggaggaaccc

SEQ ID NO: 1711 - DNA, 25 bp, Homo sapiens
ttcctgacgggcatgactgtggccg

SEQ ID NO: 1712 - DNA, 25 bp, Homo sapiens
cggaaatgaccagacactgaccatc

SEQ ID NO: 1713 - DNA, 25 bp, Homo sapiens
gaaatgaccagacactgaccatcca

SEQ ID NO: 1714 - DNA, 25 bp, Homo sapiens
gccattgccaccaggagaaccacta

SEQ ID NO: 1715 - DNA, 25 bp, Homo sapiens
gagaaccactacatgcagcccatgc

SEQ ID NO: 1716 - DNA, 25 bp, Homo sapiens
ggttgggcccagatctggtcccttg

SEQ ID NO: 1717 - DNA, 25 bp, Homo sapiens
gcagctagttttctagaatttatca

SEQ ID NO: 1718 - DNA, 25 bp, Homo sapiens
ctagaatttatcacacttctgtgag

SEQ ID NO: 1719 - DNA, 25 bp, Homo sapiens
gaatttatcacacttctgtgagacc

SEQ ID NO: 1720 - DNA, 25 bp, Homo sapiens
acctcagttcccttggcctcagaat

SEQ ID NO: 1721 - DNA, 25 bp, Homo sapiens
gttcccttggcctcagaattcacaa

SEQ ID NO: 1722 - DNA, 25 bp, Homo sapiens
tttccacaaaatctgtccaaaggag

SEQ ID NO: 1723 - DNA, 25 bp, Homo sapiens
tctgtccaaaggaggctggcaggta

SEQ ID NO: 1724 - DNA, 25 bp, Homo sapiens
atgtttgtggcctcagaattgatca

SEQ ID NO: 1725 - DNA, 25 bp, Homo sapiens
tggcctcagaattgatcattttccc

SEQ ID NO: 1726 - DNA, 25 bp, Homo sapiens
cacttgttccagctctttgaaatag

SEQ ID NO: 1727 - DNA, 25 bp, Homo sapiens
cctgcacatgaagaggcacctctga

SEQ ID NO: 1728 - DNA, 25 bp, Homo sapiens
atgaagaggcacctctgagggagca

SEQ ID NO: 1729 - DNA, 25 bp, Homo sapiens
ctccagggcctctccttggaaggtc

SEQ ID NO: 1730 - DNA, 25 bp, Homo sapiens
tccagggcctctccttggaaggtct

SEQ ID NO: 1731 - DNA, 25 bp, Homo sapiens
gcctctccttggaaggtcttttgag

SEQ ID NO: 1732 - DNA, 25 bp, Homo sapiens
atggtatgtgggtgaccctggactc

SEQ ID NO: 1733 - DNA, 25 bp, Homo sapiens
ggtgaccctggactcgccactggta

SEQ ID NO: 1734 - DNA, 25 bp, Homo sapiens
cgagcggcgcctaagcctttgccgt

SEQ ID NO: 1735 - DNA, 25 bp, Homo sapiens
cacactgagaatgctaatggttggg

SEQ ID NO: 1736 - DNA, 25 bp, Homo sapiens
tgttgaggatctattactgaccgta

SEQ ID NO: 1737 - DNA, 25 bp, Homo sapiens
tgaccgtatgatgaggccaactttt

SEQ ID NO: 1738 - DNA, 25 bp, Homo sapiens
agtataccatgagatgagatgacca

SEQ ID NO: 1739 - DNA, 25 bp, Homo sapiens
gtataccatgagatgagatgaccac

SEQ ID NO: 1740 - DNA, 25 bp, Homo sapiens
tataccatgagatgagatgaccacc

SEQ ID NO: 1741 - DNA, 25 bp, Homo sapiens
agatgagatgaccaccaatcatttc

SEQ ID NO: 1742 - DNA, 25 bp, Homo sapiens
agccttttaaatgctcccactgtga

SEQ ID NO: 1743 - DNA, 25 bp, Homo sapiens
tgccaggcttaaggagaggagaaac

SEQ ID NO: 1744 - DNA, 25 bp, Homo sapiens
cgtgctcgcccacaaactgatttct

SEQ ID NO: 1745 - DNA, 25 bp, Homo sapiens
caaactgatttctcacggcgtgtca

SEQ ID NO: 1746 - DNA, 25 bp, Homo sapiens
gcgcaagcctcactattacttgaac

SEQ ID NO: 1747 - DNA, 25 bp, Homo sapiens
aagtgcaatgcgtgttgtacataca

SEQ ID NO: 1748 - DNA, 25 bp, Homo sapiens
tgcaatgcgtgttgtacatacagag

SEQ ID NO: 1749 - DNA, 25 bp, Homo sapiens
tgtacatacagaggtaactatcaat

SEQ ID NO: 1750 - DNA, 25 bp, Homo sapiens
cccctattttaagacgtgaatgtct

SEQ ID NO: 1751 - DNA, 25 bp, Homo sapiens
gacgtgaatgtctcagcgaggtgta

SEQ ID NO: 1752 - DNA, 25 bp, Homo sapiens
gtgtaaagttgttcgccgcgtggaa

SEQ ID NO: 1753 - DNA, 25 bp, Homo sapiens
gaaagactgattacctcctgtgtgg

SEQ ID NO: 1754 - DNA, 25 bp, Homo sapiens
ctgattacctcctgtgtggaagaag

SEQ ID NO: 1755 - DNA, 25 bp, Homo sapiens
acctcctgtgtggaagaaggaaaca

SEQ ID NO: 1756 - DNA, 25 bp, Homo sapiens
gaaacaccgagtctctgtataatct

SEQ ID NO: 1757 - DNA, 25 bp, Homo sapiens
atgcgaacagcaaaccaataaactg

SEQ ID NO: 1758 - DNA, 25 bp, Homo sapiens
tccttagccttgctcaggtgcaagt

SEQ ID NO: 1759 - DNA, 25 bp, Homo sapiens
gaggctccagtttcccaccatgcgg

SEQ ID NO: 1760 - DNA, 25 bp, Homo sapiens
caccatgcggccaccgagagaacgt

SEQ ID NO: 1761 - DNA, 25 bp, Homo sapiens
caccgagagaacgtccccggtcagt

SEQ ID NO: 1762 - DNA, 25 bp, Homo sapiens
gaacgtccccggtcagtctctggtc

SEQ ID NO: 1763 - DNA, 25 bp, Homo sapiens
aacgtccccggtcagtctctggtct

SEQ ID NO: 1764 - DNA, 25 bp, Homo sapiens
gtccccggtcagtctctggtctcgt

SEQ ID NO: 1765 - DNA, 25 bp, Homo sapiens
gtcagtctctggtctcgtttgtcta

SEQ ID NO: 1766 - DNA, 25 bp, Homo sapiens
ctggtctcgtttgtctagttcctgg

SEQ ID NO: 1767 - DNA, 25 bp, Homo sapiens
gtctcgtttgtctagttcctgggag

SEQ ID NO: 1768 - DNA, 25 bp, Homo sapiens
tcgtttgtctagttcctgggagtca

SEQ ID NO: 1769 - DNA, 25 bp, Homo sapiens
ttgtctagttcctgggagtcactgc

SEQ ID NO: 1770 - DNA, 25 bp, Homo sapiens
ctagttcctgggagtcactgcagcc

SEQ ID NO: 1771 - DNA, 25 bp, Homo sapiens
tagttcctgggagtcactgcagcca

SEQ ID NO: 1772 - DNA, 25 bp, Homo sapiens
agttcctgggagtcactgcagccag

SEQ ID NO: 1773 - DNA, 25 bp, Homo sapiens
tgggagtcactgcagccagagccct

SEQ ID NO: 1774 - DNA, 25 bp, Homo sapiens
gggagtcactgcagccagagccctc

SEQ ID NO: 1775 - DNA, 25 bp, Homo sapiens
cgaggcttcaggatccagttctcgt

SEQ ID NO: 1776 - DNA, 25 bp, Homo sapiens
ggcttcaggatccagttctcgtaag

SEQ ID NO: 1777 - DNA, 25 bp, Homo sapiens
cttcaggatccagttctcgtaagct

SEQ ID NO: 1778 - DNA, 25 bp, Homo sapiens
aggatccagttctcgtaagctgcga

SEQ ID NO: 1779 - DNA, 25 bp, Homo sapiens
tccagttctcgtaagctgcgactcg

SEQ ID NO: 1780 - DNA, 25 bp, Homo sapiens
agttctcgtaagctgcgactcggcg

SEQ ID NO: 1781 - DNA, 25 bp, Homo sapiens
gttctcgtaagctgcgactcggcgc

SEQ ID NO: 1782 - DNA, 25 bp, Homo sapiens
tcgtaagctgcgactcggcgccctg

SEQ ID NO: 1783 - DNA, 25 bp, Homo sapiens
gtaagctgcgactcggcgccctgta

SEQ ID NO: 1784 - DNA, 25 bp, Homo sapiens
gactcggcgccctgtactgtggtgc

SEQ ID NO: 1785 - DNA, 25 bp, Homo sapiens
tcggcgccctgtactgtggtgcagt

SEQ ID NO: 1786 - DNA, 25 bp, Homo sapiens
cgccctgtactgtggtgcagtgtga

SEQ ID NO: 1787 - DNA, 25 bp, Homo sapiens
tgtactgtggtgcagtgtgacctgc

SEQ ID NO: 1788 - DNA, 25 bp, Homo sapiens
gtactgtggtgcagtgtgacctgca

SEQ ID NO: 1789 - DNA, 25 bp, Homo sapiens
ccatggtcacggtgctggccttcct

SEQ ID NO: 1790 - DNA, 25 bp, Homo sapiens
atggtcacggtgctggccttcctgt

SEQ ID NO: 1791 - DNA, 25 bp, Homo sapiens
tctatgccaccagctccagacagta

SEQ ID NO: 1792 - DNA, 25 bp, Homo sapiens
tatgccaccagctccagacagtaac

SEQ ID NO: 1793 - DNA, 25 bp, Homo sapiens
tgccaccagctccagacagtaacta

SEQ ID NO: 1794 - DNA, 25 bp, Homo sapiens
ccaccagctccagacagtaactaag

SEQ ID NO: 1795 - DNA, 25 bp, Homo sapiens
caccagctccagacagtaactaaga

SEQ ID NO: 1796 - DNA, 25 bp, Homo sapiens
accagctccagacagtaactaagac

SEQ ID NO: 1797 - DNA, 25 bp, Homo sapiens
cagctccagacagtaactaagactt

SEQ ID NO: 1798 - DNA, 25 bp, Homo sapiens
agctccagacagtaactaagacttc

SEQ ID NO: 1799 - DNA, 25 bp, Homo sapiens
gctccagacagtaactaagacttct

SEQ ID NO: 1800 - DNA, 25 bp, Homo sapiens
aacggatgggtctcagttacaaata

SEQ ID NO: 1801 - DNA, 25 bp, Homo sapiens
atgggtctcagttacaaataaggac

SEQ ID NO: 1802 - DNA, 25 bp, Homo sapiens
gtctcagttacaaataaggacacta

SEQ ID NO: 1803 - DNA, 25 bp, Homo sapiens
cttttggggtcagatctctggaaca

SEQ ID NO: 1804 - DNA, 25 bp, Homo sapiens
ttggggtcagatctctggaacatca

SEQ ID NO: 1805 - DNA, 25 bp, Homo sapiens
acatcatgtgatgaagctgacattt

SEQ ID NO: 1806 - DNA, 25 bp, Homo sapiens
gctctattttctgatcatgaaactg

SEQ ID NO: 1807 - DNA, 25 bp, Homo sapiens
tgggttcaggattccatggaccacc

SEQ ID NO: 1808 - DNA, 25 bp, Homo sapiens
aggattccatggaccacctggacaa

SEQ ID NO: 1809 - DNA, 25 bp, Homo sapiens
ttccatggaccacctggacaagcaa

SEQ ID NO: 1810 - DNA, 25 bp, Homo sapiens
actccgaagacttgaacactcactc

SEQ ID NO: 1811 - DNA, 25 bp, Homo sapiens
cgaagacttgaacactcactccaca

SEQ ID NO: 1812 - DNA, 25 bp, Homo sapiens
ttgaacactcactccacaacccaag

SEQ ID NO: 1813 - DNA, 25 bp, Homo sapiens
cacaacccaagaatctgcagctaac

SEQ ID NO: 1814 - DNA, 25 bp, Homo sapiens
acccaagaatctgcagctaacttat

SEQ ID NO: 1815 - DNA, 25 bp, Homo sapiens
aacattatgccttaagtaatgttaa

SEQ ID NO: 1816 - DNA, 25 bp, Homo sapiens
agtttatctttcatggtactagtgt

SEQ ID NO: 1817 - DNA, 25 bp, Homo sapiens
gaaattgcttttcctcttgaaccac

SEQ ID NO: 1818 - DNA, 25 bp, Homo sapiens
tttcctcttgaaccacagttctacc

SEQ ID NO: 1819 - DNA, 25 bp, Homo sapiens
ttgaaccacagttctacccctggga

SEQ ID NO: 1820 - DNA, 25 bp, Homo sapiens
cagttctacccctgggatgttttga

SEQ ID NO: 1821 - DNA, 25 bp, Homo sapiens
tacccctgggatgttttgagggtct

SEQ ID NO: 1822 - DNA, 25 bp, Homo sapiens
tgttttgagggtctttgcaagaatc

SEQ ID NO: 1823 - DNA, 25 bp, Homo sapiens
ttccccgaacgcaaggagcgcgaga

SEQ ID NO: 1824 - DNA, 25 bp, Homo sapiens
tccccgaacgcaaggagcgcgagat

SEQ ID NO: 1825 - DNA, 25 bp, Homo sapiens
ccccgaacgcaaggagcgcgagatg

SEQ ID NO: 1826 - DNA, 25 bp, Homo sapiens
agcgcgagatggtggccacacagca

SEQ ID NO: 1827 - DNA, 25 bp, Homo sapiens
agatggtggccacacagcaggagat

SEQ ID NO: 1828 - DNA, 25 bp, Homo sapiens
acacagcaggagatgatggacgcgc

SEQ ID NO: 1829 - DNA, 25 bp, Homo sapiens
tgaggctccagctgcgggactactg

SEQ ID NO: 1830 - DNA, 25 bp, Homo sapiens
taggagctaggtgaccctcggctgc

SEQ ID NO: 1831 - DNA, 25 bp, Homo sapiens
aggagctaggtgaccctcggctgct

SEQ ID NO: 1832 - DNA, 25 bp, Homo sapiens
gctaggtgaccctcggctgctgcag

SEQ ID NO: 1833 - DNA, 25 bp, Homo sapiens
agtggaccccaaggtggccctgtag

SEQ ID NO: 1834 - DNA, 25 bp, Homo sapiens
gtgaccctcggctgctgcagggatc

SEQ ID NO: 1835 - DNA, 25 bp, Homo sapiens
tgaccctcggctgctgcagggatct

SEQ ID NO: 1836 - DNA, 25 bp, Homo sapiens
tcaataagaaaatccctaagcagag

SEQ ID NO: 1837 - DNA, 25 bp, Homo sapiens
aagcagaggctggagagctacagaa

SEQ ID NO: 1838 - DNA, 25 bp, Homo sapiens
agctacagaaggaccaccagtagcc

SEQ ID NO: 1839 - DNA, 25 bp, Homo sapiens
gctacagaaggaccaccagtagcca

SEQ ID NO: 1840 - DNA, 25 bp, Homo sapiens
tacagaaggaccaccagtagccact

SEQ ID NO: 1841 - DNA, 25 bp, Homo sapiens
acagaaggaccaccagtagccactg

SEQ ID NO: 1842 - DNA, 25 bp, Homo sapiens
cagaaggaccaccagtagccactgt

SEQ ID NO: 1843 - DNA, 25 bp, Homo sapiens
agaaggaccaccagtagccactgtc

SEQ ID NO: 1844 - DNA, 25 bp, Homo sapiens
accagtagccactgtccccgggaag

SEQ ID NO: 1845 - DNA, 25 bp, Homo sapiens
cagtagccactgtccccgggaagct

SEQ ID NO: 1846 - DNA, 25 bp, Homo sapiens
ccaaagctttgaacattcatgactg

SEQ ID NO: 1847 - DNA, 25 bp, Homo sapiens
caaagctttgaacattcatgactga

SEQ ID NO: 1848 - DNA, 25 bp, Homo sapiens
agctttgaacattcatgactgaact

SEQ ID NO: 1849 - DNA, 25 bp, Homo sapiens
tcccttctctacctcatgggggtat

SEQ ID NO: 1850 - DNA, 25 bp, Homo sapiens
cttgcaagaatcagtgcaaagattt

SEQ ID NO: 1851 - DNA, 25 bp, Homo sapiens
taagatatgatgtccctatggaagc

SEQ ID NO: 1852 - DNA, 25 bp, Homo sapiens
tttagtgaacactgttctctgggtg

SEQ ID NO: 1853 - DNA, 25 bp, Homo sapiens
tctctgggtgacaatacgtaaagaa

SEQ ID NO: 1854 - DNA, 25 bp, Homo sapiens
gaaatctctttggattctggtcatg

SEQ ID NO: 1855 - DNA, 25 bp, Homo sapiens
ctctttggattctggtcatgagaag

SEQ ID NO: 1856 - DNA, 25 bp, Homo sapiens
aatttccagccttcaagaagacaga

SEQ ID NO: 1857 - DNA, 25 bp, Homo sapiens
cagccttcaagaagacagacattta

SEQ ID NO: 1858 - DNA, 25 bp, Homo sapiens
ccttcaagaagacagacatttagaa

SEQ ID NO: 1859 - DNA, 25 bp, Homo sapiens
tgggtggccatcgatctggaccgtc

SEQ ID NO: 1860 - DNA, 25 bp, Homo sapiens
gggtggccatcgatctggaccgtcc

SEQ ID NO: 1861 - DNA, 25 bp, Homo sapiens
tgctccccgtgagcactgcgtacaa

SEQ ID NO: 1862 - DNA, 25 bp, Homo sapiens
accagaactgtgtgtctcatggtat

SEQ ID NO: 1863 - DNA, 25 bp, Homo sapiens
tgaaatgaggcctactctaaagaat

SEQ ID NO: 1864 - DNA, 25 bp, Homo sapiens
actaactgctagaagagaagactct

SEQ ID NO: 1865 - DNA, 25 bp, Homo sapiens
agactctgggttatactggtgcgag

SEQ ID NO: 1866 - DNA, 25 bp, Homo sapiens
gcgcagccctgagttggagcttcaa

SEQ ID NO: 1867 - DNA, 25 bp, Homo sapiens
ccctgagttggagcttcaagtgctt

SEQ ID NO: 1868 - DNA, 25 bp, Homo sapiens
aaatgggaattccagcactaagcca

SEQ ID NO: 1869 - DNA, 25 bp, Homo sapiens
accgggcagaagctgggccttccgc

SEQ ID NO: 1870 - DNA, 25 bp, Homo sapiens
cagcttgacttctttccagtccacg

SEQ ID NO: 1871 - DNA, 25 bp, Homo sapiens
agcttgacttctttccagtccacgt

SEQ ID NO: 1872 - DNA, 25 bp, Homo sapiens
gtccacgtgtgtatataatgatatc

SEQ ID NO: 1873 - DNA, 25 bp, Homo sapiens
atatttttgcccaggtctgggtatt

SEQ ID NO: 1874 - DNA, 25 bp, Homo sapiens
ttttgcccaggtctgggtattgctc

SEQ ID NO: 1875 - DNA, 25 bp, Homo sapiens
tttgcccaggtctgggtattgctcc

SEQ ID NO: 1876 - DNA, 25 bp, Homo sapiens
cccaggtctgggtattgctcctgcc

SEQ ID NO: 1877 - DNA, 25 bp, Homo sapiens
tctgggtattgctcctgcccagacc

SEQ ID NO: 1878 - DNA, 25 bp, Homo sapiens
gggtattgctcctgcccagaccctg

SEQ ID NO: 1879 - DNA, 25 bp, Homo sapiens
cctgacatccctttccactgtgtgt

SEQ ID NO: 1880 - DNA, 25 bp, Homo sapiens
gacatccctttccactgtgtgtgtg

SEQ ID NO: 1881 - DNA, 25 bp, Homo sapiens
acatccctttccactgtgtgtgtga

SEQ ID NO: 1882 - DNA, 25 bp, Homo sapiens
ccactgtgtgtgtgaccatgctggg

SEQ ID NO: 1883 - DNA, 25 bp, Homo sapiens
actctgcttggaattaaaaggttgc

SEQ ID NO: 1884 - DNA, 25 bp, Homo sapiens
gccttatcgcggtggccgtgttcct

SEQ ID NO: 1885 - DNA, 25 bp, Homo sapiens
gtgttcctggtcctcgttgcaatcg

SEQ ID NO: 1886 - DNA, 25 bp, Homo sapiens
gcctttgcagtcaaccacttctggt

SEQ ID NO: 1887 - DNA, 25 bp, Homo sapiens
gcagtcaaccacttctggtgccagg

SEQ ID NO: 1888 - DNA, 25 bp, Homo sapiens
aaccacttctggtgccaggaggagc

SEQ ID NO: 1889 - DNA, 25 bp, Homo sapiens
aggaggagccggagcctgcacacat

SEQ ID NO: 1890 - DNA, 25 bp, Homo sapiens
ggaaggtactcttcgatggcggcca

SEQ ID NO: 1891 - DNA, 25 bp, Homo sapiens
aaggtactcttcgatggcggccagt

SEQ ID NO: 1892 - DNA, 25 bp, Homo sapiens
tcgatggcggccagtttcaggtcca

SEQ ID NO: 1893 - DNA, 25 bp, Homo sapiens
gcggccagtttcaggtccagtgagc

SEQ ID NO: 1894 - DNA, 25 bp, Homo sapiens
aggtccagtgagcatgagaatgcct

SEQ ID NO: 1895 - DNA, 25 bp, Homo sapiens
gtccagtgagcatgagaatgcctat

SEQ ID NO: 1896 - DNA, 25 bp, Homo sapiens
agaatgcctatgagaatgtgcccga

SEQ ID NO: 1897 - DNA, 25 bp, Homo sapiens
ttctgggcctgctcacggcagtgcc

SEQ ID NO: 1898 - DNA, 25 bp, Homo sapiens
ggcagtgccacctgccagctgtcag

SEQ ID NO: 1899 - DNA, 25 bp, Homo sapiens
agccctggatgcagggccttatcgc

SEQ ID NO: 1900 - DNA, 25 bp, Homo sapiens
ttctaaagagcctgcgaaagccttt

SEQ ID NO: 1901 - DNA, 25 bp, Homo sapiens
tacaaggacttgtactagcagagag

SEQ ID NO: 1902 - DNA, 25 bp, Homo sapiens
caaggacttgtactagcagagagtc

SEQ ID NO: 1903 - DNA, 25 bp, Homo sapiens
gacttgtactagcagagagtcctga

SEQ ID NO: 1904 - DNA, 25 bp, Homo sapiens
cttgtactagcagagagtcctgagc

SEQ ID NO: 1905 - DNA, 25 bp, Homo sapiens
tgtactagcagagagtcctgagcca

SEQ ID NO: 1906 - DNA, 25 bp, Homo sapiens
tactagcagagagtcctgagccact

SEQ ID NO: 1907 - DNA, 25 bp, Homo sapiens
ctagcagagagtcctgagccactgc

SEQ ID NO: 1908 - DNA, 25 bp, Homo sapiens
agcagagagtcctgagccactgcca

SEQ ID NO: 1909 - DNA, 25 bp, Homo sapiens
cagagagtcctgagccactgccaac

SEQ ID NO: 1910 - DNA, 25 bp, Homo sapiens
gagtcctgagccactgccaacattt

SEQ ID NO: 1911 - DNA, 25 bp, Homo sapiens
ttcttccagttgcactattctgagg

SEQ ID NO: 1912 - DNA, 25 bp, Homo sapiens
agttgcactattctgagggaaaatc

SEQ ID NO: 1913 - DNA, 25 bp, Homo sapiens
gttgcactattctgagggaaaatct

SEQ ID NO: 1914 - DNA, 25 bp, Homo sapiens
ttgcactattctgagggaaaatctg

SEQ ID NO: 1915 - DNA, 25 bp, Homo sapiens
tgcactattctgagggaaaatctga

SEQ ID NO: 1916 - DNA, 25 bp, Homo sapiens
ttctcagtgccttggccctgttgag

SEQ ID NO: 1917 - DNA, 25 bp, Homo sapiens
gtgccttggccctgttgagtctatc

SEQ ID NO: 1918 - DNA, 25 bp, Homo sapiens
tctggtaacactggagctgactccc

SEQ ID NO: 1919 - DNA, 25 bp, Homo sapiens
actggagctgactccctgggaagag

SEQ ID NO: 1920 - DNA, 25 bp, Homo sapiens
tgactccctgggaagagaggccaaa

SEQ ID NO: 1921 - DNA, 25 bp, Homo sapiens
ctccctgggaagagaggccaaatgt

SEQ ID NO: 1922 - DNA, 25 bp, Homo sapiens
aatacttatcccaatgaatgcgtgt

SEQ ID NO: 1923 - DNA, 25 bp, Homo sapiens
tatcccaatgaatgcgtgttatgtt

SEQ ID NO: 1924 - DNA, 25 bp, Homo sapiens
tcctcattcaaaaatctgggccttg

SEQ ID NO: 1925 - DNA, 25 bp, Homo sapiens
cattcaaaaatctgggccttgctga

SEQ ID NO: 1926 - DNA, 25 bp, Homo sapiens
aatctgggccttgctgagaaccaag

SEQ ID NO: 1927 - DNA, 25 bp, Homo sapiens
tgctgagaaccaaggttttgaaatc

SEQ ID NO: 1928 - DNA, 25 bp, Homo sapiens
ttttgaaatcccatcaggtcaccgc

SEQ ID NO: 1929 - DNA, 25 bp, Homo sapiens
ttgaaatcccatcaggtcaccgcga

SEQ ID NO: 1930 - DNA, 25 bp, Homo sapiens
gcctgactggccttattgttgaata

SEQ ID NO: 1931 - DNA, 25 bp, Homo sapiens
cctgactggccttattgttgaataa

SEQ ID NO: 1932 - DNA, 25 bp, Homo sapiens
taaatgccatgtggagatagagccc

SEQ ID NO: 1933 - DNA, 25 bp, Homo sapiens
aaatgccatgtggagatagagcccc

SEQ ID NO: 1934 - DNA, 25 bp, Homo sapiens
atgccatgtggagatagagccccag

SEQ ID NO: 1935 - DNA, 25 bp, Homo sapiens
agatagagccccagatgtttcagcc

SEQ ID NO: 1936 - DNA, 25 bp, Homo sapiens
gatagagccccagatgtttcagcca

SEQ ID NO: 1937 - DNA, 25 bp, Homo sapiens
atagagccccagatgtttcagccat

SEQ ID NO: 1938 - DNA, 25 bp, Homo sapiens
tagagccccagatgtttcagccatc

SEQ ID NO: 1939 - DNA, 25 bp, Homo sapiens
agccccagatgtttcagccatctca

SEQ ID NO: 1940 - DNA, 25 bp, Homo sapiens
gccccagatgtttcagccatctcag

SEQ ID NO: 1941 - DNA, 25 bp, Homo sapiens
gatgtttcagccatctcagcccagg

SEQ ID NO: 1942 - DNA, 25 bp, Homo sapiens
tgtttcagccatctcagcccaggca

SEQ ID NO: 1943 - DNA, 25 bp, Homo sapiens
atgtagccccagcagatgtgatata

SEQ ID NO: 1944 - DNA, 25 bp, Homo sapiens
tgtagccccagcagatgtgatatag

SEQ ID NO: 1945 - DNA, 25 bp, Homo sapiens
gtagccccagcagatgtgatataga

SEQ ID NO: 1946 - DNA, 25 bp, Homo sapiens
tagccccagcagatgtgatatagag

SEQ ID NO: 1947 - DNA, 25 bp, Homo sapiens
ccccagcagatgtgatatagagaag

SEQ ID NO: 1948 - DNA, 25 bp, Homo sapiens
cacgctggccgagtactgcgtgaag

SEQ ID NO: 1949 - DNA, 25 bp, Homo sapiens
gctggccgagtactgcgtgaagacc

SEQ ID NO: 1950 - DNA, 25 bp, Homo sapiens
gcgcccgacgagggctcagacctct

SEQ ID NO: 1951 - DNA, 25 bp, Homo sapiens
cccgacgagggctcagacctcttct

SEQ ID NO: 1952 - DNA, 25 bp, Homo sapiens
cgacgagggctcagacctcttctac

SEQ ID NO: 1953 - DNA, 25 bp, Homo sapiens
cgagggctcagacctcttctacgac

SEQ ID NO: 1954 - DNA, 25 bp, Homo sapiens
gggctcagacctcttctacgacgac

SEQ ID NO: 1955 - DNA, 25 bp, Homo sapiens
acctcttctacgacgactactacga

SEQ ID NO: 1956 - DNA, 25 bp, Homo sapiens
tcttctacgacgactactacgagga

SEQ ID NO: 1957 - DNA, 25 bp, Homo sapiens
tctacgacgactactacgaggacgg

SEQ ID NO: 1958 - DNA, 25 bp, Homo sapiens
actactacgaggacggcgaggtgga

SEQ ID NO: 1959 - DNA, 25 bp, Homo sapiens
gccgacagctgcttcggggacgatg

SEQ ID NO: 1960 - DNA, 25 bp, Homo sapiens
ctgcttcggggacgatgaggatgac

SEQ ID NO: 1961 - DNA, 25 bp, Homo sapiens
ttcggggacgatgaggatgactctg

SEQ ID NO: 1962 - DNA, 25 bp, Homo sapiens
atgactctggcacggaggagtcctg

SEQ ID NO: 1963 - DNA, 25 bp, Homo sapiens
actctggcacggaggagtcctgaca

SEQ ID NO: 1964 - DNA, 25 bp, Homo sapiens
atattatactttagggcaaccctag

SEQ ID NO: 1965 - DNA, 25 bp, Homo sapiens
tactttagggcaaccctagttggca

SEQ ID NO: 1966 - DNA, 25 bp, Homo sapiens
ttagggcaaccctagttggcagctt

SEQ ID NO: 1967 - DNA, 25 bp, Homo sapiens
tagggcaaccctagttggcagcttt

SEQ ID NO: 1968 - DNA, 25 bp, Homo sapiens
agggcaaccctagttggcagctttg

SEQ ID NO: 1969 - DNA, 25 bp, Homo sapiens
ggcaaccctagttggcagctttgag

SEQ ID NO: 1970 - DNA, 25 bp, Homo sapiens
accctagttggcagctttgagagaa

SEQ ID NO: 1971 - DNA, 25 bp, Homo sapiens
ccctagttggcagctttgagagaag

SEQ ID NO: 1972 - DNA, 25 bp, Homo sapiens
cctagttggcagctttgagagaagt

SEQ ID NO: 1973 - DNA, 25 bp, Homo sapiens
ttggcagctttgagagaagttcttc

SEQ ID NO: 1974 - DNA, 25 bp, Homo sapiens
ttccattaaacatggaaggaataac

SEQ ID NO: 1975 - DNA, 25 bp, Homo sapiens
aatagggaacttgacagcagacaga

SEQ ID NO: 1976 - DNA, 25 bp, Homo sapiens
atagggaacttgacagcagacagag

SEQ ID NO: 1977 - DNA, 25 bp, Homo sapiens
ggaacttgacagcagacagagggaa

SEQ ID NO: 1978 - DNA, 25 bp, Homo sapiens
gaacttgacagcagacagagggaag

SEQ ID NO: 1979 - DNA, 25 bp, Homo sapiens
acttgacagcagacagagggaagag

SEQ ID NO: 1980 - DNA, 25 bp, Homo sapiens
agtatcagacacagccccagaaggg

SEQ ID NO: 1981 - DNA, 25 bp, Homo sapiens
tccccataggccatttggactctgc

SEQ ID NO: 1982 - DNA, 25 bp, Homo sapiens
ataggccatttggactctgccttca

SEQ ID NO: 1983 - DNA, 25 bp, Homo sapiens
gactctgccttcaaacaaaggcagt

SEQ ID NO: 1984 - DNA, 25 bp, Homo sapiens
agtccacaggcatggaagctgtgag

SEQ ID NO: 1985 - DNA, 25 bp, Homo sapiens
gggacaggcctgtgcgtgccatcca

SEQ ID NO: 1986 - DNA, 25 bp, Homo sapiens
cctgtgcgtgccatccagagtcatc

SEQ ID NO: 1987 - DNA, 25 bp, Homo sapiens
gcgtgccatccagagtcatctcagc

SEQ ID NO: 1988 - DNA, 25 bp, Homo sapiens
tcagccctgcctttctctggagcat

SEQ ID NO: 1989 - DNA, 25 bp, Homo sapiens
cctgcctttctctggagcattctga

SEQ ID NO: 1990 - DNA, 25 bp, Homo sapiens
tggcccagggaatccagccatgacc

SEQ ID NO: 1991 - DNA, 25 bp, Homo sapiens
acccctctgccaaagtactcttagg

SEQ ID NO: 1992 - DNA, 25 bp, Homo sapiens
tgccagtctggtaactgaactccct

SEQ ID NO: 1993 - DNA, 25 bp, Homo sapiens
aactccctctggaggcaggcttgag

SEQ ID NO: 1994 - DNA, 25 bp, Homo sapiens
gggaggattcctcagggttcccttg

SEQ ID NO: 1995 - DNA, 25 bp, Homo sapiens
ggaggattcctcagggttcccttga

SEQ ID NO: 1996 - DNA, 25 bp, Homo sapiens
tcattcctggtcctggggagacgcc

SEQ ID NO: 1997 - DNA, 25 bp, Homo sapiens
cattcctggtcctggggagacgccc

SEQ ID NO: 1998 - DNA, 25 bp, Homo sapiens
gacagatttccctttagacccagca

SEQ ID NO: 1999 - DNA, 25 bp, Homo sapiens
atttcatttctggagctccatttgt

SEQ ID NO: 2000 - DNA, 25 bp, Homo sapiens
taaactacagatgtcaactccttgg

SEQ ID NO: 2001 - DNA, 25 bp, Homo sapiens
actacagatgtcaactccttggggt

SEQ ID NO: 2002 - DNA, 25 bp, Homo sapiens
gatgtcaactccttggggtgctgat

SEQ ID NO: 2003 - DNA, 25 bp, Homo sapiens
aactccttggggtgctgatctcgag

SEQ ID NO: 2004 - DNA, 25 bp, Homo sapiens
tgctgatctcgagtgttattttctg

SEQ ID NO: 2005 - DNA, 25 bp, Homo sapiens
tgcactcccagaaaccttttaagag

SEQ ID NO: 2006 - DNA, 25 bp, Homo sapiens
gcactcccagaaaccttttaagaga

SEQ ID NO: 2007 - DNA, 25 bp, Homo sapiens
ttggccttgggaatagttggctgcc

SEQ ID NO: 2008 - DNA, 25 bp, Homo sapiens
tagttggctgccaatctccctgctc

SEQ ID NO: 2009 - DNA, 25 bp, Homo sapiens
ccctgctcttggttctcctctagat

SEQ ID NO: 2010 - DNA, 25 bp, Homo sapiens
tcttggttctcctctagattgaagt

SEQ ID NO: 2011 - DNA, 25 bp, Homo sapiens
ttctgatgctgttcttaccagatta

SEQ ID NO: 2012 - DNA, 25 bp, Homo sapiens
tattttcctgtcagcatctgagctt

SEQ ID NO: 2013 - DNA, 25 bp, Homo sapiens
cagcatctgagcttgaggatggtag

SEQ ID NO: 2014 - DNA, 25 bp, Homo sapiens
ggccagggcgcagtcagctccagtc

SEQ ID NO: 2015 - DNA, 25 bp, Homo sapiens
cgcagtcagctccagtcccagagag

SEQ ID NO: 2016 - DNA, 25 bp, Homo sapiens
agtcagctccagtcccagagagctc

SEQ ID NO: 2017 - DNA, 25 bp, Homo sapiens
ccagagagctcctctctaactcaga

SEQ ID NO: 2018 - DNA, 25 bp, Homo sapiens
gctcctctctaactcagagcaactg

SEQ ID NO: 2019 - DNA, 25 bp, Homo sapiens
ctctaactcagagcaactgaactga

SEQ ID NO: 2020 - DNA, 25 bp, Homo sapiens
ctcagagcaactgaactgagacaga

SEQ ID NO: 2021 - DNA, 25 bp, Homo sapiens
ctgaactgagacagaggaggaaaac

SEQ ID NO: 2022 - DNA, 25 bp, Homo sapiens
aacagagcatcagaagcctgcagtg

SEQ ID NO: 2023 - DNA, 25 bp, Homo sapiens
atcagaagcctgcagtggtggttgt

SEQ ID NO: 2024 - DNA, 25 bp, Homo sapiens
cccaacctgggattgctgagcaggg

SEQ ID NO: 2025 - DNA, 25 bp, Homo sapiens
cagggaagctttgcatgttgctcta

SEQ ID NO: 2026 - DNA, 25 bp, Homo sapiens
agctttgcatgttgctctaaggtac

SEQ ID NO: 2027 - DNA, 25 bp, Homo sapiens
gcatgttgctctaaggtacattttt

SEQ ID NO: 2028 - DNA, 25 bp, Homo sapiens
tgggacggcctcctctcctactttg

SEQ ID NO: 2029 - DNA, 25 bp, Homo sapiens
tctcctactttgggacgcccacgtg

SEQ ID NO: 2030 - DNA, 25 bp, Homo sapiens
tcctactttgggacgcccacgtggc

SEQ ID NO: 2031 - DNA, 25 bp, Homo sapiens
ttgggacgcccacgtggcagaccgt

SEQ ID NO: 2032 - DNA, 25 bp, Homo sapiens
gggacgcccacgtggcagaccgtga

SEQ ID NO: 2033 - DNA, 25 bp, Homo sapiens
gacgcccacgtggcagaccgtgacc

SEQ ID NO: 2034 - DNA, 25 bp, Homo sapiens
cgcccacgtggcagaccgtgaccat

SEQ ID NO: 2035 - DNA, 25 bp, Homo sapiens
cccacgtggcagaccgtgaccatct

SEQ ID NO: 2036 - DNA, 25 bp, Homo sapiens
ccacgtggcagaccgtgaccatctt

SEQ ID NO: 2037 - DNA, 25 bp, Homo sapiens
cacgtggcagaccgtgaccatcttt

SEQ ID NO: 2038 - DNA, 25 bp, Homo sapiens
acgtggcagaccgtgaccatctttg

SEQ ID NO: 2039 - DNA, 25 bp, Homo sapiens
cgtggcagaccgtgaccatctttgt

SEQ ID NO: 2040 - DNA, 25 bp, Homo sapiens
tggcagaccgtgaccatctttgtgg

SEQ ID NO: 2041 - DNA, 25 bp, Homo sapiens
ggcagaccgtgaccatctttgtggc

SEQ ID NO: 2042 - DNA, 25 bp, Homo sapiens
gcagaccgtgaccatctttgtggcg

SEQ ID NO: 2043 - DNA, 25 bp, Homo sapiens
cagaccgtgaccatctttgtggcgg

SEQ ID NO: 2044 - DNA, 25 bp, Homo sapiens
tgaagtgtttcacgagagcccggga

SEQ ID NO: 2045 - DNA, 25 bp, Homo sapiens
agtgtttcacgagagcccgggagct

SEQ ID NO: 2046 - DNA, 25 bp, Homo sapiens
agccttctccactggccggagtcag

SEQ ID NO: 2047 - DNA, 25 bp, Homo sapiens
gtcagtgccaggtccttgccctttg

SEQ ID NO: 2048 - DNA, 25 bp, Homo sapiens
ccctttgtggaaagtcacaggtcac

SEQ ID NO: 2049 - DNA, 25 bp, Homo sapiens
gtctgaagccaatgctgtctggttg

SEQ ID NO: 2050 - DNA, 25 bp, Homo sapiens
atgctgtctggttgcgccatttttg

SEQ ID NO: 2051 - DNA, 25 bp, Homo sapiens
tttatgagggccacgggtctgtgtt

SEQ ID NO: 2052 - DNA, 25 bp, Homo sapiens
ggccacgggtctgtgttcgactcag

SEQ ID NO: 2053 - DNA, 25 bp, Homo sapiens
gcctcagggacgactctgacctctt

SEQ ID NO: 2054 - DNA, 25 bp, Homo sapiens
acctcttggccacagaggactcact

SEQ ID NO: 2055 - DNA, 25 bp, Homo sapiens
ttggccacagaggactcacttgccc

SEQ ID NO: 2056 - DNA, 25 bp, Homo sapiens
ccctccttgtctgtgcatccggggg

SEQ ID NO: 2057 - DNA, 25 bp, Homo sapiens
cgggactccagaaccgcagaagcct

SEQ ID NO: 2058 - DNA, 25 bp, Homo sapiens
aggacggccggctctctatagcacc

SEQ ID NO: 2059 - DNA, 25 bp, Homo sapiens
ctctctatagcaccagggctcacgt

SEQ ID NO: 2060 - DNA, 25 bp, Homo sapiens
cgagctgtggcaatggaattcagca

SEQ ID NO: 2061 - DNA, 25 bp, Homo sapiens
cctgcgatagcctcaacaaccgatg

SEQ ID NO: 2062 - DNA, 25 bp, Homo sapiens
gcgatagcctcaacaaccgatgtga

SEQ ID NO: 2063 - DNA, 25 bp, Homo sapiens
tagcctcaacaaccgatgtgagggc

SEQ ID NO: 2064 - DNA, 25 bp, Homo sapiens
tgttggcccagcgactctgcggacg

SEQ ID NO: 2065 - DNA, 25 bp, Homo sapiens
ggcccagcgactctgcggacgatgg

SEQ ID NO: 2066 - DNA, 25 bp, Homo sapiens
cgactctgcggacgatggctggtct

SEQ ID NO: 2067 - DNA, 25 bp, Homo sapiens
ctctgcggacgatggctggtctcca

SEQ ID NO: 2068 - DNA, 25 bp, Homo sapiens
cggacgatggctggtctccatggtc

SEQ ID NO: 2069 - DNA, 25 bp, Homo sapiens
tccatggtccgagtggacctcctgt

SEQ ID NO: 2070 - DNA, 25 bp, Homo sapiens
tggtccgagtggacctcctgttcta

SEQ ID NO: 2071 - DNA, 25 bp, Homo sapiens
tccgagtggacctcctgttctacga

SEQ ID NO: 2072 - DNA, 25 bp, Homo sapiens
agtggacctcctgttctacgagctg

SEQ ID NO: 2073 - DNA, 25 bp, Homo sapiens
gacctcctgttctacgagctgtggc

SEQ ID NO: 2074 - DNA, 25 bp, Homo sapiens
ctcctgttctacgagctgtggcaat

SEQ ID NO: 2075 - DNA, 25 bp, Homo sapiens
tgttctacgagctgtggcaatggaa

SEQ ID NO: 2076 - DNA, 25 bp, Homo sapiens
caggaggtgccctggtacacctgct

SEQ ID NO: 2077 - DNA, 25 bp, Homo sapiens
aggaggtgccctggtacacctgctt

SEQ ID NO: 2078 - DNA, 25 bp, Homo sapiens
ggaggtgccctggtacacctgcttg

SEQ ID NO: 2079 - DNA, 25 bp, Homo sapiens
gaggtgccctggtacacctgcttga

SEQ ID NO: 2080 - DNA, 25 bp, Homo sapiens
aggtgccctggtacacctgcttgac

SEQ ID NO: 2081 - DNA, 25 bp, Homo sapiens
ggtgccctggtacacctgcttgacc

SEQ ID NO: 2082 - DNA, 25 bp, Homo sapiens
gtgccctggtacacctgcttgacct

SEQ ID NO: 2083 - DNA, 25 bp, Homo sapiens
tgccctggtacacctgcttgacctt

SEQ ID NO: 2084 - DNA, 25 bp, Homo sapiens
tggtacacctgcttgaccttccctg

SEQ ID NO: 2085 - DNA, 25 bp, Homo sapiens
ggtacacctgcttgaccttccctgt

SEQ ID NO: 2086 - DNA, 25 bp, Homo sapiens
gtacacctgcttgaccttccctgtg

SEQ ID NO: 2087 - DNA, 25 bp, Homo sapiens
ccatcccagatctcaaagtgtttga

SEQ ID NO: 2088 - DNA, 25 bp, Homo sapiens
catcccagatctcaaagtgtttgag

SEQ ID NO: 2089 - DNA, 25 bp, Homo sapiens
atcccagatctcaaagtgtttgagc

SEQ ID NO: 2090 - DNA, 25 bp, Homo sapiens
tcccagatctcaaagtgtttgagcg

SEQ ID NO: 2091 - DNA, 25 bp, Homo sapiens
cccagatctcaaagtgtttgagcgt

SEQ ID NO: 2092 - DNA, 25 bp, Homo sapiens
ccagatgcaatcaatgccccagtca

SEQ ID NO: 2093 - DNA, 25 bp, Homo sapiens
agatgcaatcaatgccccagtcacc

SEQ ID NO: 2094 - DNA, 25 bp, Homo sapiens
aacttcaccaataggaagatctcag

SEQ ID NO: 2095 - DNA, 25 bp, Homo sapiens
acttcaccaataggaagatctcagt

SEQ ID NO: 2096 - DNA, 25 bp, Homo sapiens
cagtgcagaggctcgcgagctatag

SEQ ID NO: 2097 - DNA, 25 bp, Homo sapiens
tatagaagaatcaccagcagcaagt

SEQ ID NO: 2098 - DNA, 25 bp, Homo sapiens
caagtgtcccaaagaagctgtgatc

SEQ ID NO: 2099 - DNA, 25 bp, Homo sapiens
agcaaacccaaactccgaagacttg

SEQ ID NO: 2100 - DNA, 25 bp, Homo sapiens
gcaaacccaaactccgaagacttga

SEQ ID NO: 2101 - DNA, 25 bp, Homo sapiens
ggaaattgcttttcctcttgaacca

SEQ ID NO: 2102 - DNA, 25 bp, Homo sapiens
tcttgaaccacagttctacccctgg

SEQ ID NO: 2103 - DNA, 25 bp, Homo sapiens
gaaccacagttctacccctgggatg

SEQ ID NO: 2104 - DNA, 25 bp, Homo sapiens
cagttctacccctgggatgttttga

SEQ ID NO: 2105 - DNA, 25 bp, Homo sapiens
tacccctgggatgttttgagggtct

SEQ ID NO: 2106 - DNA, 25 bp, Homo sapiens
ccctgggatgttttgagggtctttg

SEQ ID NO: 2107 - DNA, 25 bp, Homo sapiens
ggtctttgcaagaatcattaataca

SEQ ID NO: 2108 - DNA, 25 bp, Homo sapiens
ctctgtcagagtgaacagcaccgcg

SEQ ID NO: 2109 - DNA, 25 bp, Homo sapiens
cccacacacactcaaggggtcgaaa

SEQ ID NO: 2110 - DNA, 25 bp, Homo sapiens
cacacacactcaaggggtcgaaaac

SEQ ID NO: 2111 - DNA, 25 bp, Homo sapiens
ctgtcggtctcagtacgttcacttt

SEQ ID NO: 2112 - DNA, 25 bp, Homo sapiens
tcagtacgttcactttatagctgct

SEQ ID NO: 2113 - DNA, 25 bp, Homo sapiens
ctttatagctgctggcaatatcgaa

SEQ ID NO: 2114 - DNA, 25 bp, Homo sapiens
agctgctggcaatatcgaaggttcc

SEQ ID NO: 2115 - DNA, 25 bp, Homo sapiens
ggcaatatcgaaggttccttttttg

SEQ ID NO: 2116 - DNA, 25 bp, Homo sapiens
gtgtaaactctaatttctatcaagg

SEQ ID NO: 2117 - DNA, 25 bp, Homo sapiens
ctctaatttctatcaaggtgtcatg

SEQ ID NO: 2118 - DNA, 25 bp, Homo sapiens
ctaatttctatcaaggtgtcatgga

SEQ ID NO: 2119 - DNA, 25 bp, Homo sapiens
ttcattacaaatgtctcagcattgg

SEQ ID NO: 2120 - DNA, 25 bp, Homo sapiens
tacaaatgtctcagcattggttaac

SEQ ID NO: 2121 - DNA, 25 bp, Homo sapiens
aaatgtctcagcattggttaactaa

SEQ ID NO: 2122 - DNA, 25 bp, Homo sapiens
tgtctcagcattggttaactaattt

SEQ ID NO: 2123 - DNA, 25 bp, Homo sapiens
gtctcagcattggttaactaatttt

SEQ ID NO: 2124 - DNA, 25 bp, Homo sapiens
tggctcggggataagacccagcctt

SEQ ID NO: 2125 - DNA, 25 bp, Homo sapiens
gggataagacccagcctttccacac

SEQ ID NO: 2126 - DNA, 25 bp, Homo sapiens
cagcctttccacacattagtttgtg

SEQ ID NO: 2127 - DNA, 25 bp, Homo sapiens
gcctttccacacattagtttgtgat

SEQ ID NO: 2128 - DNA, 25 bp, Homo sapiens
tccacacattagtttgtgatgctgg

SEQ ID NO: 2129 - DNA, 25 bp, Homo sapiens
cacattagtttgtgatgctgggtca

SEQ ID NO: 2130 - DNA, 25 bp, Homo sapiens
tgtgatgctgggtcatagtgcgtct

SEQ ID NO: 2131 - DNA, 25 bp, Homo sapiens
gcgtctgtttgctccctgtcaaggg

SEQ ID NO: 2132 - DNA, 25 bp, Homo sapiens
ttgctccctgtcaagggaccagtaa

SEQ ID NO: 2133 - DNA, 25 bp, Homo sapiens
ccctgtcaagggaccagtaacatga

SEQ ID NO: 2134 - DNA, 25 bp, Homo sapiens
aagggaccagtaacatgaggggtca

SEQ ID NO: 2135 - DNA, 25 bp, Homo sapiens
accagtaacatgaggggtcagagaa

SEQ ID NO: 2136 - DNA, 25 bp, Homo sapiens
aagggatcagaactctcgtgggcct

SEQ ID NO: 2137 - DNA, 25 bp, Homo sapiens
tcagaactctcgtgggcctccagtg

SEQ ID NO: 2138 - DNA, 25 bp, Homo sapiens
ctctcgtgggcctccagtgtgtcgc

SEQ ID NO: 2139 - DNA, 25 bp, Homo sapiens
ccagtgtgtcgcaagtttttgctgt

SEQ ID NO: 2140 - DNA, 25 bp, Homo sapiens
ccggtgtggcgtggaacctcaagca

SEQ ID NO: 2141 - DNA, 25 bp, Homo sapiens
agcaggggcaattccacctcaccag

SEQ ID NO: 2142 - DNA, 25 bp, Homo sapiens
cagatgcaaggcatctcagcaccct

SEQ ID NO: 2143 - DNA, 25 bp, Homo sapiens
agatgcaaggcatctcagcaccctc

SEQ ID NO: 2144 - DNA, 25 bp, Homo sapiens
gctcctggagccagggtgctcgtct

SEQ ID NO: 2145 - DNA, 25 bp, Homo sapiens
gcctttgcccacactggcgcatggg

SEQ ID NO: 2146 - DNA, 25 bp, Homo sapiens
aaaggggcttcctgcaccacacatg

SEQ ID NO: 2147 - DNA, 25 bp, Homo sapiens
gattgagggccgtccctgtgctcct

SEQ ID NO: 2148 - DNA, 25 bp, Homo sapiens
gccgcgcaggcagaagggatctccc

SEQ ID NO: 2149 - DNA, 25 bp, Homo sapiens
ccgcgcaggcagaagggatctccca

SEQ ID NO: 2150 - DNA, 25 bp, Homo sapiens
ctgccccagcacatggggattttgc

SEQ ID NO: 2151 - DNA, 25 bp, Homo sapiens
aggctcctccagaaggggcgctctc

SEQ ID NO: 2152 - DNA, 25 bp, Homo sapiens
ctcctaggtggcatccacacaaggg

SEQ ID NO: 2153 - DNA, 25 bp, Homo sapiens
aaatccggaaggactgggacgcgca

SEQ ID NO: 2154 - DNA, 25 bp, Homo sapiens
ccacagggccaaggtgtgcttgcgc

SEQ ID NO: 2155 - DNA, 25 bp, Homo sapiens
agggccaaggtgtgcttgcgccacc

SEQ ID NO: 2156 - DNA, 25 bp, Homo sapiens
tgcccctagccaaggagtgtgaatt

SEQ ID NO: 2157 - DNA, 25 bp, Homo sapiens
gtccctttgccacaagtctgtgggg

SEQ ID NO: 2158 - DNA, 25 bp, Homo sapiens
ctgtggggcaagaggctgcaatatt

SEQ ID NO: 2159 - DNA, 25 bp, Homo sapiens
tgtctgggctgctaacctggcctgc

SEQ ID NO: 2160 - DNA, 25 bp, Homo sapiens
tctgggctgctaacctggcctgctc

SEQ ID NO: 2161 - DNA, 25 bp, Homo sapiens
gtccaggcttaaggtggatgcactt

SEQ ID NO: 2162 - DNA, 25 bp, Homo sapiens
ctgtgtagcagctttaacccacgtt

SEQ ID NO: 2163 - DNA, 25 bp, Homo sapiens
tttaacccacgtttgtctgtcacgt

SEQ ID NO: 2164 - DNA, 25 bp, Homo sapiens
ccacgtttgtctgtcacgtccagtc

SEQ ID NO: 2165 - DNA, 25 bp, Homo sapiens
ttgtctgtcacgtccagtcccgaga

SEQ ID NO: 2166 - DNA, 25 bp, Homo sapiens
gtctgtcacgtccagtcccgagacg

SEQ ID NO: 2167 - DNA, 25 bp, Homo sapiens
cgtccagtcccgagacggctgagtg

SEQ ID NO: 2168 - DNA, 25 bp, Homo sapiens
tccagtcccgagacggctgagtgac

SEQ ID NO: 2169 - DNA, 25 bp, Homo sapiens
tcccgagacggctgagtgaccccaa

SEQ ID NO: 2170 - DNA, 25 bp, Homo sapiens
gacggctgagtgaccccaagaaagg

SEQ ID NO: 2171 - DNA, 25 bp, Homo sapiens
tgagtgaccccaagaaaggcttccc

SEQ ID NO: 2172 - DNA, 25 bp, Homo sapiens
tttctaccatttcagagaggccttt

SEQ ID NO: 2173 - DNA, 25 bp, Homo sapiens
tgtggcccctgaacaagaattggaa

SEQ ID NO: 2174 - DNA, 25 bp, Homo sapiens
cctgcccatgggagctggttagaaa

SEQ ID NO: 2175 - DNA, 25 bp, Homo sapiens
ccatgggagctggttagaaatgcag

SEQ ID NO: 2176 - DNA, 25 bp, Homo sapiens
tgtgtctgctcagtaatttgaggac

SEQ ID NO: 2177 - DNA, 25 bp, Homo sapiens
gactgcttccaattttctggaatac

SEQ ID NO: 2178 - DNA, 25 bp, Homo sapiens
gcttccaattttctggaatacatga

SEQ ID NO: 2179 - DNA, 25 bp, Homo sapiens
gttataagtagcaggccaagtcagg

SEQ ID NO: 2180 - DNA, 25 bp, Homo sapiens
ccttattttcaagaaactgaggaat

SEQ ID NO: 2181 - DNA, 25 bp, Homo sapiens
agctttgctctttggtagaaaaggc

SEQ ID NO: 2182 - DNA, 25 bp, Homo sapiens
ctaggtacacagctctagacactgc

SEQ ID NO: 2183 - DNA, 25 bp, Homo sapiens
ccacacagggtctgcaaggtctttg

SEQ ID NO: 2184 - DNA, 25 bp, Homo sapiens
agggtctgcaaggtctttggttcag

SEQ ID NO: 2185 - DNA, 25 bp, Homo sapiens
atgaaatcctgcttcagtgtatgga

SEQ ID NO: 2186 - DNA, 25 bp, Homo sapiens
cctgcttcagtgtatggaaataaat

SEQ ID NO: 2187 - DNA, 25 bp, Homo sapiens
gataatctagaacacaggcaaaatc

SEQ ID NO: 2188 - DNA, 25 bp, Homo sapiens
aatcgacgagctcatctgcgccttt

SEQ ID NO: 2189 - DNA, 25 bp, Homo sapiens
tgcgcctttgtttagaacgcttaaa

SEQ ID NO: 2190 - DNA, 25 bp, Homo sapiens
gattccactaggaccagactgcacc

SEQ ID NO: 2191 - DNA, 25 bp, Homo sapiens
cggcacacaacacttggtttgctca

SEQ ID NO: 2192 - DNA, 25 bp, Homo sapiens
ccagctcgagaatttggaacgagaa

SEQ ID NO: 2193 - DNA, 25 bp, Homo sapiens
tggaacagctgcagggtcctcagga

SEQ ID NO: 2194 - DNA, 25 bp, Homo sapiens
atacgaatggacagcattggatcaa

SEQ ID NO: 2195 - DNA, 25 bp, Homo sapiens
cagatcgttctgattcagagcgaga

SEQ ID NO: 2196 - DNA, 25 bp, Homo sapiens
gaaagcacagagttctcccatggag

SEQ ID NO: 2197 - DNA, 25 bp, Homo sapiens
accagcatcagtgacattgatgacc

SEQ ID NO: 2198 - DNA, 25 bp, Homo sapiens
tattgggagtgacgagggttactcc

SEQ ID NO: 2199 - DNA, 25 bp, Homo sapiens
cagtgccagtgtcaaactttcattc

SEQ ID NO: 2200 - DNA, 25 bp, Homo sapiens
agcatgacataacagtgcagggcaa

SEQ ID NO: 2201 - DNA, 25 bp, Homo sapiens
ttcactgggccaattcaatacaaac

SEQ ID NO: 2202 - DNA, 25 bp, Homo sapiens
caaacaatctcttaaattgggttca

SEQ ID NO: 2203 - DNA, 25 bp, Homo sapiens
ggttcatgatgcagtctcctcttta

SEQ ID NO: 2204 - DNA, 25 bp, Homo sapiens
ccgcctcattgagatgtaccgagac

SEQ ID NO: 2205 - DNA, 25 bp, Homo sapiens
atgtaccgagacctcttccagcagg

SEQ ID NO: 2206 - DNA, 25 bp, Homo sapiens
ccgagacctcttccagcaggggacc

SEQ ID NO: 2207 - DNA, 25 bp, Homo sapiens
gctgtcctcgctgctgagaagagcc

SEQ ID NO: 2208 - DNA, 25 bp, Homo sapiens
cctcgctgctgagaagagccactaa

SEQ ID NO: 2209 - DNA, 25 bp, Homo sapiens
tgagaagagccactaactcgtgacc

SEQ ID NO: 2210 - DNA, 25 bp, Homo sapiens
gagccactaactcgtgacctccagc

SEQ ID NO: 2211 - DNA, 25 bp, Homo sapiens
gccgtgtgctcctgccttcctgatc

SEQ ID NO: 2212 - DNA, 25 bp, Homo sapiens
tcctgccttcctgatcctctgtaga

SEQ ID NO: 2213 - DNA, 25 bp, Homo sapiens
tgactgccttcagacctggccctgt

SEQ ID NO: 2214 - DNA, 25 bp, Homo sapiens
tgagcaggtgggccgttgagttacc

SEQ ID NO: 2215 - DNA, 25 bp, Homo sapiens
aggtgggccgttgagttacctctgt

SEQ ID NO: 2216 - DNA, 25 bp, Homo sapiens
ggccgttgagttacctctgtgctgg

SEQ ID NO: 2217 - DNA, 25 bp, Homo sapiens
tgagttacctctgtgctggatcccg

SEQ ID NO: 2218 - DNA, 25 bp, Homo sapiens
tacctctgtgctggatcccgtgccc

SEQ ID NO: 2219 - DNA, 25 bp, Homo sapiens
gtcctgccttgttattgtaagtgcc

SEQ ID NO: 2220 - DNA, 25 bp, Homo sapiens
ttttactgctgaggagaaggctgcc

SEQ ID NO: 2221 - DNA, 25 bp, Homo sapiens
tttactgctgaggagaaggctgccg

SEQ ID NO: 2222 - DNA, 25 bp, Homo sapiens
tcaagcccgcctttgctaagctgag

SEQ ID NO: 2223 - DNA, 25 bp, Homo sapiens
caagcccgcctttgctaagctgagt

SEQ ID NO: 2224 - DNA, 25 bp, Homo sapiens
gctcctgggtaacgtgatggtgatt

SEQ ID NO: 2225 - DNA, 25 bp, Homo sapiens
ctcctgggtaacgtgatggtgatta

SEQ ID NO: 2226 - DNA, 25 bp, Homo sapiens
atggtgattattctggctactcact

SEQ ID NO: 2227 - DNA, 25 bp, Homo sapiens
gagttctcttccagtttgcaggtgt

SEQ ID NO: 2228 - DNA, 25 bp, Homo sapiens
ggtgttcctgtgaccctgacaccct

SEQ ID NO: 2229 - DNA, 25 bp, Homo sapiens
accctccttctgcacatggggactg

SEQ ID NO: 2230 - DNA, 25 bp, Homo sapiens
ccctccttctgcacatggggactgg

SEQ ID NO: 2231 - DNA, 25 bp, Homo sapiens
tccttctgcacatggggactgggct

SEQ ID NO: 2232 - DNA, 25 bp, Homo sapiens
ctgggcttggccttgagagaaagcc

SEQ ID NO: 2233 - DNA, 25 bp, Homo sapiens
ggcttggccttgagagaaagccttc

SEQ ID NO: 2234 - DNA, 25 bp, Homo sapiens
cactagcaagctctcaggcctggca

SEQ ID NO: 2235 - DNA, 25 bp, Homo sapiens
cctggcatcatggtgcattttactg

SEQ ID NO: 2236 - DNA, 25 bp, Homo sapiens
accaaatcgaccagcttcagcgaga

SEQ ID NO: 2237 - DNA, 25 bp, Homo sapiens
tcgaccagcttcagcgagagcagcg

SEQ ID NO: 2238 - DNA, 25 bp, Homo sapiens
agcttcagcgagagcagcgacacct

SEQ ID NO: 2239 - DNA, 25 bp, Homo sapiens
gcattgagaggatccggatggacag

SEQ ID NO: 2240 - DNA, 25 bp, Homo sapiens
agagcacggactatctcacaggtga

SEQ ID NO: 2241 - DNA, 25 bp, Homo sapiens
cggactatctcacaggtgatctgga

SEQ ID NO: 2242 - DNA, 25 bp, Homo sapiens
atctcacaggtgatctggactggag

SEQ ID NO: 2243 - DNA, 25 bp, Homo sapiens
atctggactggagcagcagcagtgt

SEQ ID NO: 2244 - DNA, 25 bp, Homo sapiens
actggagcagcagcagtgtgagcga

SEQ ID NO: 2245 - DNA, 25 bp, Homo sapiens
gcatgcagagcctcggcagtgatga

SEQ ID NO: 2246 - DNA, 25 bp, Homo sapiens
gtgatgagggctattccagcaccag

SEQ ID NO: 2247 - DNA, 25 bp, Homo sapiens
agggctattccagcaccagcatcaa

SEQ ID NO: 2248 - DNA, 25 bp, Homo sapiens
attccagcaccagcatcaagagaat

SEQ ID NO: 2249 - DNA, 25 bp, Homo sapiens
taaagctgcaggacagtcacaaggc

SEQ ID NO: 2250 - DNA, 25 bp, Homo sapiens
ttggtctctaagagagtgggcactg

SEQ ID NO: 2251 - DNA, 25 bp, Homo sapiens
ggcactgcggctgtctccttgaagg

SEQ ID NO: 2252 - DNA, 25 bp, Homo sapiens
gctgtgtgccccagtttgagaagtg

SEQ ID NO: 2253 - DNA, 25 bp, Homo sapiens
atttaaccatcgttgctggtatttt

SEQ ID NO: 2254 - DNA, 25 bp, Homo sapiens
cgttgctggtattttcataggcatt

SEQ ID NO: 2255 - DNA, 25 bp, Homo sapiens
ttttcataggcattgcattgctgca

SEQ ID NO: 2256 - DNA, 25 bp, Homo sapiens
atatttgggatatgcctggcccaga

SEQ ID NO: 2257 - DNA, 25 bp, Homo sapiens
tgcctggcccagaatttggttagcg

SEQ ID NO: 2258 - DNA, 25 bp, Homo sapiens
atatcgaagctgtcagggcgagctg

SEQ ID NO: 2259 - DNA, 25 bp, Homo sapiens
gtcagggcgagctggtagaccccct

SEQ ID NO: 2260 - DNA, 25 bp, Homo sapiens
ctgcaagacactggacagacccagc

SEQ ID NO: 2261 - DNA, 25 bp, Homo sapiens
gcgtgccgaactgatcttcgagctg

SEQ ID NO: 2262 - DNA, 25 bp, Homo sapiens
ctgatcttcgagctgcatggaccta

SEQ ID NO: 2263 - DNA, 25 bp, Homo sapiens
gagctgcatggacctaatcacagat

SEQ ID NO: 2264 - DNA, 25 bp, Homo sapiens
gacctaatcacagatgcagcctgca

SEQ ID NO: 2265 - DNA, 25 bp, Homo sapiens
ggaaatgctgctcactgacagaatt

SEQ ID NO: 2266 - DNA, 25 bp, Homo sapiens
cgtgaatctctactgtagccatgaa

SEQ ID NO: 2267 - DNA, 25 bp, Homo sapiens
accagatgtacttgaatgtgcagaa

SEQ ID NO: 2268 - DNA, 25 bp, Homo sapiens
aaaggttcaggcattcctagccgag

SEQ ID NO: 2269 - DNA, 25 bp, Homo sapiens
ggttcaggcattcctagccgagtgt

SEQ ID NO: 2270 - DNA, 25 bp, Homo sapiens
gcggctgcagtctacaaactttgcc

SEQ ID NO: 2271 - DNA, 25 bp, Homo sapiens
gcagtctacaaactttgccctggcc

SEQ ID NO: 2272 - DNA, 25 bp, Homo sapiens
ctgtgctgccctgaagaatggcgcc

SEQ ID NO: 2273 - DNA, 25 bp, Homo sapiens
tacctgatttcttcagggctgctgg

SEQ ID NO: 2274 - DNA, 25 bp, Homo sapiens
cacactggttctcaatgaaaaatag

SEQ ID NO: 2275 - DNA, 25 bp, Homo sapiens
cactggttctcaatgaaaaatagtg

SEQ ID NO: 2276 - DNA, 25 bp, Homo sapiens
agtccacaggaagaggttgaactaa

SEQ ID NO: 2277 - DNA, 25 bp, Homo sapiens
agaagatagctgaccagctggaaga

SEQ ID NO: 2278 - DNA, 25 bp, Homo sapiens
agagcttactggaatccagcagggt

SEQ ID NO: 2279 - DNA, 25 bp, Homo sapiens
tactggaatccagcagggttttctg

SEQ ID NO: 2280 - DNA, 25 bp, Homo sapiens
gcccaaggatttgcaagctgaagct

SEQ ID NO: 2281 - DNA, 25 bp, Homo sapiens
gcaagctgaagctctctgcaaactt

SEQ ID NO: 2282 - DNA, 25 bp, Homo sapiens
tctctgcaaacttgataggagagta

SEQ ID NO: 2283 - DNA, 25 bp, Homo sapiens
tgacacactgatcctgccagaaaat

SEQ ID NO: 2284 - DNA, 25 bp, Homo sapiens
cctatttgagggtgtctgtctggag

SEQ ID NO: 2285 - DNA, 25 bp, Homo sapiens
ctgtctggagacttagagtttgtca

SEQ ID NO: 2286 - DNA, 25 bp, Homo sapiens
cctcccatgtgcagacagtgtgtct

SEQ ID NO: 2287 - DNA, 25 bp, Homo sapiens
catgtgcagacagtgtgtctttata

SEQ ID NO: 2288 - DNA, 25 bp, Homo sapiens
tttccccaatgatgtcggtaatttc

SEQ ID NO: 2289 - DNA, 25 bp, Homo sapiens
tccccaatgatgtcggtaatttctg

SEQ ID NO: 2290 - DNA, 25 bp, Homo sapiens
aatttctgatgtttctgaagttccc

SEQ ID NO: 2291 - DNA, 25 bp, Homo sapiens
cacccagtgtgacaaccctcggtgt

SEQ ID NO: 2292 - DNA, 25 bp, Homo sapiens
acccagtgtgacaaccctcggtgtg

SEQ ID NO: 2293 - DNA, 25 bp, Homo sapiens
cggtgtggatatacccccgtggact

SEQ ID NO: 2294 - DNA, 25 bp, Homo sapiens
atacccccgtggactcatggctctt

SEQ ID NO: 2295 - DNA, 25 bp, Homo sapiens
tctctgttgcaaaactcagctaagt

SEQ ID NO: 2296 - DNA, 25 bp, Homo sapiens
tctgttgcaaaactcagctaagttc

SEQ ID NO: 2297 - DNA, 25 bp, Homo sapiens
gcaaaactcagctaagttcctgctt

SEQ ID NO: 2298 - DNA, 25 bp, Homo sapiens
taagttcctgcttccaccttgatgt

SEQ ID NO: 2299 - DNA, 25 bp, Homo sapiens
cctgcttccaccttgatgttgaaat

SEQ ID NO: 2300 - DNA, 25 bp, Homo sapiens
cacattcctagttccccgtgaactt

SEQ ID NO: 2301 - DNA, 25 bp, Homo sapiens
ccgtgaacttcctttgacttattgt

SEQ ID NO: 2302 - DNA, 25 bp, Homo sapiens
tgaacttcctttgacttattgtccc

SEQ ID NO: 2303 - DNA, 25 bp, Homo sapiens
cttttaatgccttccacattaatta

SEQ ID NO: 2304 - DNA, 25 bp, Homo sapiens
ttaatgccttccacattaattagat

SEQ ID NO: 2305 - DNA, 25 bp, Homo sapiens
ccttccacattaattagattttctt

SEQ ID NO: 2306 - DNA, 25 bp, Homo sapiens
taaagatgccctaagtgttgaagaa

SEQ ID NO: 2307 - DNA, 25 bp, Homo sapiens
tgccctaagtgttgaagaagagttt

SEQ ID NO: 2308 - DNA, 25 bp, Homo sapiens
tattaaagcaccaaattcatgtaca

SEQ ID NO: 2309 - DNA, 25 bp, Homo sapiens
taaagcaccaaattcatgtacagca

SEQ ID NO: 2310 - DNA, 25 bp, Homo sapiens
agcaccaaattcatgtacagcatgc

SEQ ID NO: 2311 - DNA, 25 bp, Homo sapiens
aaattcatgtacagcatgcatcacg

SEQ ID NO: 2312 - DNA, 25 bp, Homo sapiens
ttcatgtacagcatgcatcacggat

SEQ ID NO: 2313 - DNA, 25 bp, Homo sapiens
atgtacagcatgcatcacggatcaa

SEQ ID NO: 2314 - DNA, 25 bp, Homo sapiens
atgcatcacggatcaatagactgta

SEQ ID NO: 2315 - DNA, 25 bp, Homo sapiens
atagactgtacttattttccaataa

SEQ ID NO: 2316 - DNA, 25 bp, Homo sapiens
tagtcaccaatgcagcaggagggct

SEQ ID NO: 2317 - DNA, 25 bp, Homo sapiens
gagatcgtttccctgccatgtctga

SEQ ID NO: 2318 - DNA, 25 bp, Homo sapiens
ctgccatgtctgatgcctacgaccg

SEQ ID NO: 2319 - DNA, 25 bp, Homo sapiens
tgtctgatgcctacgaccggactat

SEQ ID NO: 2320 - DNA, 25 bp, Homo sapiens
gcacctatgtgatggtggcaggccc

SEQ ID NO: 2321 - DNA, 25 bp, Homo sapiens
ctgtggcagaatgtcgtgtgctgca

SEQ ID NO: 2322 - DNA, 25 bp, Homo sapiens
cagaatgtcgtgtgctgcagaagct

SEQ ID NO: 2323 - DNA, 25 bp, Homo sapiens
ctgttggcatgagtacagtaccaga

SEQ ID NO: 2324 - DNA, 25 bp, Homo sapiens
tcgttgcacggcactgtggacttcg

SEQ ID NO: 2325 - DNA, 25 bp, Homo sapiens
gagtctttggcttctcactcatcac

SEQ ID NO: 2326 - DNA, 25 bp, Homo sapiens
ttggcttctcactcatcactaacaa

SEQ ID NO: 2327 - DNA, 25 bp, Homo sapiens
tcatcactaacaaggtcatcatgga

SEQ ID NO: 2328 - DNA, 25 bp, Homo sapiens
cagctggcaaacaagctgcacagaa

SEQ ID NO: 2329 - DNA, 25 bp, Homo sapiens
gcaaacaagctgcacagaaattgga

SEQ ID NO: 2330 - DNA, 25 bp, Homo sapiens
ttgtctccattcttatggccagcat

SEQ ID NO: 2331 - DNA, 25 bp, Homo sapiens
ccattcttatggccagcattccact

SEQ ID NO: 2332 - DNA, 25 bp, Homo sapiens
cttctacaggcttttgggaagtagg

SEQ ID NO: 2333 - DNA, 25 bp, Homo sapiens
ggccacagcttaggtttggagctct

SEQ ID NO: 2334 - DNA, 25 bp, Homo sapiens
cttaggtttggagctctggatgtac

SEQ ID NO: 2335 - DNA, 25 bp, Homo sapiens
tggagctctggatgtacatacataa

SEQ ID NO: 2336 - DNA, 25 bp, Homo sapiens
agcagtgggacgtgtttctgtcata

SEQ ID NO: 2337 - DNA, 25 bp, Homo sapiens
cagtgggacgtgtttctgtcataat

SEQ ID NO: 2338 - DNA, 25 bp, Homo sapiens
tgggacgtgtttctgtcataatgca

SEQ ID NO: 2339 - DNA, 25 bp, Homo sapiens
tctgtcataatgcaggcatgaaggg

SEQ ID NO: 2340 - DNA, 25 bp, Homo sapiens
ctgtcataatgcaggcatgaagggt

SEQ ID NO: 2341 - DNA, 25 bp, Homo sapiens
agcagatgttacagtcttagggatc

SEQ ID NO: 2342 - DNA, 25 bp, Homo sapiens
agatgttacagtcttagggatccgg

SEQ ID NO: 2343 - DNA, 25 bp, Homo sapiens
atgttacagtcttagggatccggga

SEQ ID NO: 2344 - DNA, 25 bp, Homo sapiens
tgttacagtcttagggatccgggat

SEQ ID NO: 2345 - DNA, 25 bp, Homo sapiens
tagaaagggtcgtcactcctttaat

SEQ ID NO: 2346 - DNA, 25 bp, Homo sapiens
agggtcgtcactcctttaatcctct

SEQ ID NO: 2347 - DNA, 25 bp, Homo sapiens
gggtcgtcactcctttaatcctcta

SEQ ID NO: 2348 - DNA, 25 bp, Homo sapiens
tcgcttaaggacagcaggaaccatc

SEQ ID NO: 2349 - DNA, 25 bp, Homo sapiens
accatctgccttgagacctttaaag

SEQ ID NO: 2350 - DNA, 25 bp, Homo sapiens
cctttaaagacttccctcagatggg

SEQ ID NO: 2351 - DNA, 25 bp, Homo sapiens
aagaccattgcaattggaaaagttc

SEQ ID NO: 2352 - DNA, 25 bp, Homo sapiens
tgaaactggttccagagaaagacta

SEQ ID NO: 2353 - DNA, 25 bp, Homo sapiens
atgaccctgcacaatactgtgagga

SEQ ID NO: 2354 - DNA, 25 bp, Homo sapiens
ctgcacaatactgtgaggaaaattg

SEQ ID NO: 2355 - DNA, 25 bp, Homo sapiens
aaattgactgcagaagcctacttca

SEQ ID NO: 2356 - DNA, 25 bp, Homo sapiens
attgactgcagaagcctacttcaca

SEQ ID NO: 2357 - DNA, 25 bp, Homo sapiens
tctccccatattttgcaaagaggaa

SEQ ID NO: 2358 - DNA, 25 bp, Homo sapiens
tccccatattttgcaaagaggaaat

SEQ ID NO: 2359 - DNA, 25 bp, Homo sapiens
ggaaattcacagcaaaagtccacat

SEQ ID NO: 2360 - DNA, 25 bp, Homo sapiens
gctttctcatattgagagctctgct

SEQ ID NO: 2361 - DNA, 25 bp, Homo sapiens
gccactgttgaatttttcccaagat

SEQ ID NO: 2362 - DNA, 25 bp, Homo sapiens
tatttagtatttttcccccaggcag

SEQ ID NO: 2363 - DNA, 25 bp, Homo sapiens
tgtgtgtgcacatgttacaaaggca

SEQ ID NO: 2364 - DNA, 25 bp, Homo sapiens
ctatgggacagctttacgagaagga

SEQ ID NO: 2365 - DNA, 25 bp, Homo sapiens
agatggattcttatatgtggcctac

SEQ ID NO: 2366 - DNA, 25 bp, Homo sapiens
agagaacacttttggcttctgaggg

SEQ ID NO: 2367 - DNA, 25 bp, Homo sapiens
cttctgagggccattgctgggctag

SEQ ID NO: 2368 - DNA, 25 bp, Homo sapiens
aggtgcaccgtaactgcttgtgtat

SEQ ID NO: 2369 - DNA, 25 bp, Homo sapiens
tcacatagacctattagtgcatttg

SEQ ID NO: 2370 - DNA, 25 bp, Homo sapiens
cctattagtgcatttgtaactggat

SEQ ID NO: 2371 - DNA, 25 bp, Homo sapiens
tctttttgtgcattgtcctcatgcc

SEQ ID NO: 2372 - DNA, 25 bp, Homo sapiens
catgcctgtattctccaggaaactt

SEQ ID NO: 2373 - DNA, 25 bp, Homo sapiens
aaatccttagcagtcagaacacttg

SEQ ID NO: 2374 - DNA, 25 bp, Homo sapiens
aatccttagcagtcagaacacttgc

SEQ ID NO: 2375 - DNA, 25 bp, Homo sapiens
tagcagtcagaacacttgcttcact

SEQ ID NO: 2376 - DNA, 25 bp, Homo sapiens
gtcagaacacttgcttcactagaat

SEQ ID NO: 2377 - DNA, 25 bp, Homo sapiens
tagaatatgccaactgccaatcatg

SEQ ID NO: 2378 - DNA, 25 bp, Homo sapiens
ctgagctaatttgttcctctttctg

SEQ ID NO: 2379 - DNA, 25 bp, Homo sapiens
gttcctctttctgaaactattaagg

SEQ ID NO: 2380 - DNA, 25 bp, Homo sapiens
ctgtcaatgccctgtggggcaaagt

SEQ ID NO: 2381 - DNA, 25 bp, Homo sapiens
gtcaatgccctgtggggcaaagtga

SEQ ID NO: 2382 - DNA, 25 bp, Homo sapiens
gacactttcttctgacataacagtg

SEQ ID NO: 2383 - DNA, 25 bp, Homo sapiens
tggctcacaagtaccattgagatcc

SEQ ID NO: 2384 - DNA, 25 bp, Homo sapiens
gctcacaagtaccattgagatcctg

SEQ ID NO: 2385 - DNA, 25 bp, Homo sapiens
caacctcaaacagacaccatggtgc

SEQ ID NO: 2386 - DNA, 25 bp, Homo sapiens
cttgggaacacaatgcctacttcaa

SEQ ID NO: 2387 - DNA, 25 bp, Homo sapiens
ttgggaacacaatgcctacttcaag

SEQ ID NO: 2388 - DNA, 25 bp, Homo sapiens
gaacacaatgcctacttcaagggta

SEQ ID NO: 2389 - DNA, 25 bp, Homo sapiens
aacacaatgcctacttcaagggtat

SEQ ID NO: 2390 - DNA, 25 bp, Homo sapiens
cacaatgcctacttcaagggtatgg

SEQ ID NO: 2391 - DNA, 25 bp, Homo sapiens
atgcctacttcaagggtatggcttc

SEQ ID NO: 2392 - DNA, 25 bp, Homo sapiens
acaccatggtgcatctgactcctga

SEQ ID NO: 2393 - DNA, 25 bp, Homo sapiens
tctgactcctgaggagaagactgct

SEQ ID NO: 2394 - DNA, 25 bp, Homo sapiens
ggagaagactgctgtcaatgccctg

SEQ ID NO: 2395 - DNA, 25 bp, Homo sapiens
gactgctgtcaatgccctgtggggc

SEQ ID NO: 2396 - DNA, 25 bp, Homo sapiens
cttttaggtaactggctttcctgct

SEQ ID NO: 2397 - DNA, 25 bp, Homo sapiens
ggtaactggctttcctgctggtccg

SEQ ID NO: 2398 - DNA, 25 bp, Homo sapiens
cctgctggtccgtgcgggaaattca

SEQ ID NO: 2399 - DNA, 25 bp, Homo sapiens
gtccgtgcgggaaattcagtcttga

SEQ ID NO: 2400 - DNA, 25 bp, Homo sapiens
acagcccttggcttgtgttatcgga

SEQ ID NO: 2401 - DNA, 25 bp, Homo sapiens
gttcacaggtgacaccttgtttgtg

SEQ ID NO: 2402 - DNA, 25 bp, Homo sapiens
aggtgacaccttgtttgtggctggc

SEQ ID NO: 2403 - DNA, 25 bp, Homo sapiens
gtgtaaagctctgctggaggtcttg

SEQ ID NO: 2404 - DNA, 25 bp, Homo sapiens
caccctggcagaggagtttacctac

SEQ ID NO: 2405 - DNA, 25 bp, Homo sapiens
ctacaaccccttcatgagagtgagg

SEQ ID NO: 2406 - DNA, 25 bp, Homo sapiens
ccccttcatgagagtgagggagaag

SEQ ID NO: 2407 - DNA, 25 bp, Homo sapiens
cccttcatgagagtgagggagaaga

SEQ ID NO: 2408 - DNA, 25 bp, Homo sapiens
caggtgagacggacccggtgaccac

SEQ ID NO: 2409 - DNA, 25 bp, Homo sapiens
aggaccagttcaagatgccccggga

SEQ ID NO: 2410 - DNA, 25 bp, Homo sapiens
cttcagcggatttggggattaggct

SEQ ID NO: 2411 - DNA, 25 bp, Homo sapiens
gattaggctcttttaggtaactggc

SEQ ID NO: 2412 - DNA, 25 bp, Homo sapiens
tccagacgccctctgagcgagggcg

SEQ ID NO: 2413 - DNA, 25 bp, Homo sapiens
cctctgttctggtggccccagctgt

SEQ ID NO: 2414 - DNA, 25 bp, Homo sapiens
tctggtggccccagctgtgactgag

SEQ ID NO: 2415 - DNA, 25 bp, Homo sapiens
ggagaccaggcttcccaaaccaagt

SEQ ID NO: 2416 - DNA, 25 bp, Homo sapiens
cagaggacagtgctgaccccaggaa

SEQ ID NO: 2417 - DNA, 25 bp, Homo sapiens
agaggacagtgctgaccccaggaag

SEQ ID NO: 2418 - DNA, 25 bp, Homo sapiens
gatgctggccccaaaagccttacgg

SEQ ID NO: 2419 - DNA, 25 bp, Homo sapiens
caaaggagggcctcagagacagcgc

SEQ ID NO: 2420 - DNA, 25 bp, Homo sapiens
ggcctcagagacagcgcgagtagca

SEQ ID NO: 2421 - DNA, 25 bp, Homo sapiens
attcctgcttaatgtcagtctacag

SEQ ID NO: 2422 - DNA, 25 bp, Homo sapiens
atgtcagtctacaggcctttcagga

SEQ ID NO: 2423 - DNA, 25 bp, Homo sapiens
ggaatcgtacattttgcttgcgtgc

SEQ ID NO: 2424 - DNA, 25 bp, Homo sapiens
tttgcttgcgtgctgggacagctag

SEQ ID NO: 2425 - DNA, 25 bp, Homo sapiens
ggacagctaggctgagatgcaccaa

SEQ ID NO: 2426 - DNA, 25 bp, Homo sapiens
ccttcactggagaccggaattgaga

SEQ ID NO: 2427 - DNA, 25 bp, Homo sapiens
agttcagagggtgtcgtcctgcagt

SEQ ID NO: 2428 - DNA, 25 bp, Homo sapiens
gtgccactgggcttcctggaaggcc

SEQ ID NO: 2429 - DNA, 25 bp, Homo sapiens
gaattcgtggccttccgggcattaa

SEQ ID NO: 2430 - DNA, 25 bp, Homo sapiens
aattcgtggccttccgggcattaag

SEQ ID NO: 2431 - DNA, 25 bp, Homo sapiens
ccccctggtgctcttggtttgaggg

SEQ ID NO: 2432 - DNA, 25 bp, Homo sapiens
gctcttggtttgaggggacctaaag

SEQ ID NO: 2433 - DNA, 25 bp, Homo sapiens
agcgtggccctccaggaagaggtcc

SEQ ID NO: 2434 - DNA, 25 bp, Homo sapiens
gcgtggccctccaggaagaggtccc

SEQ ID NO: 2435 - DNA, 25 bp, Homo sapiens
ataggtctcccaggtgacccaggcc

SEQ ID NO: 2436 - DNA, 25 bp, Homo sapiens
tcctggagtgcctggacccccggga

SEQ ID NO: 2437 - DNA, 25 bp, Homo sapiens
tggagtgcctggacccccgggacct

SEQ ID NO: 2438 - DNA, 25 bp, Homo sapiens
gacctcctgggcttcccggtttctg

SEQ ID NO: 2439 - DNA, 25 bp, Homo sapiens
ggcttcccggtttctgtgagccagc

SEQ ID NO: 2440 - DNA, 25 bp, Homo sapiens
ttcccggtttctgtgagccagcctc

SEQ ID NO: 2441 - DNA, 25 bp, Homo sapiens
ccggtttctgtgagccagcctcctg

SEQ ID NO: 2442 - DNA, 25 bp, Homo sapiens
ctcctgcaccatgcaggctggtcag

SEQ ID NO: 2443 - DNA, 25 bp, Homo sapiens
agcatttaacaaagggcctgaccct

SEQ ID NO: 2444 - DNA, 25 bp, Homo sapiens
tccagccctacagagactgagcggt

SEQ ID NO: 2445 - DNA, 25 bp, Homo sapiens
cctacagagactgagcggtgcatcg

SEQ ID NO: 2446 - DNA, 25 bp, Homo sapiens
gctgtcttccagaagtatgctggaa

SEQ ID NO: 2447 - DNA, 25 bp, Homo sapiens
cttccagaagtatgctggaaaggat

SEQ ID NO: 2448 - DNA, 25 bp, Homo sapiens
cttcatgaatacagaactagctgcc

SEQ ID NO: 2449 - DNA, 25 bp, Homo sapiens
gccttcacaaagaaccagaaggacc

SEQ ID NO: 2450 - DNA, 25 bp, Homo sapiens
aaggaccctggtgtccttgaccgca

SEQ ID NO: 2451 - DNA, 25 bp, Homo sapiens
accctggtgtccttgaccgcatgat

SEQ ID NO: 2452 - DNA, 25 bp, Homo sapiens
acagtgatggtcagctagatttctc

SEQ ID NO: 2453 - DNA, 25 bp, Homo sapiens
gaatttcttaatctgattggtggcc

SEQ ID NO: 2454 - DNA, 25 bp, Homo sapiens
cttaatctgattggtggcctagcta

SEQ ID NO: 2455 - DNA, 25 bp, Homo sapiens
ctagctatggcttgccatgactcct

SEQ ID NO: 2456 - DNA, 25 bp, Homo sapiens
atggcttgccatgactccttcctca

SEQ ID NO: 2457 - DNA, 25 bp, Homo sapiens
gccatgactccttcctcaaggctgt

SEQ ID NO: 2458 - DNA, 25 bp, Homo sapiens
gaagcggacctgaggaccccttggc

SEQ ID NO: 2459 - DNA, 25 bp, Homo sapiens
acctgccaatagtaataaagcaatg

SEQ ID NO: 2460 - DNA, 25 bp, Homo sapiens
tttgaagagggtgcagcccagatga

SEQ ID NO: 2461 - DNA, 25 bp, Homo sapiens
gacctgcacccctgatgtggcatat

SEQ ID NO: 2462 - DNA, 25 bp, Homo sapiens
cctcatctttgacgtggagctgctc

SEQ ID NO: 2463 - DNA, 25 bp, Homo sapiens
actgggacggctcctgcttttgggg

SEQ ID NO: 2464 - DNA, 25 bp, Homo sapiens
ttggggctcttgatcagtgtgctaa

SEQ ID NO: 2465 - DNA, 25 bp, Homo sapiens
catcatccattctctctgcccaagt

SEQ ID NO: 2466 - DNA, 25 bp, Homo sapiens
ccaagttgctctgtatgtgttcgtc

SEQ ID NO: 2467 - DNA, 25 bp, Homo sapiens
ttgcttgaggaaacttcggttgcag

SEQ ID NO: 2468 - DNA, 25 bp, Homo sapiens
attttgtgtgatgcatgtagtagcc

SEQ ID NO: 2469 - DNA, 25 bp, Homo sapiens
ctttcctgataacagaacacagatc

SEQ ID NO: 2470 - DNA, 25 bp, Homo sapiens
cagatctcttgttcgcacaatctac

SEQ ID NO: 2471 - DNA, 25 bp, Homo sapiens
tcacttaaaccacacacacaaggtg

SEQ ID NO: 2472 - DNA, 25 bp, Homo sapiens
caaggtgctcagacatgaaatgtac

SEQ ID NO: 2473 - DNA, 25 bp, Homo sapiens
gtaccgtacacagagggacttgagc

SEQ ID NO: 2474 - DNA, 25 bp, Homo sapiens
gagccagttacctttgctgtcactt

SEQ ID NO: 2475 - DNA, 25 bp, Homo sapiens
tagctgctcacttaaacaatgtcct

SEQ ID NO: 2476 - DNA, 25 bp, Homo sapiens
atcaatcgtgcatccttagtgaact

SEQ ID NO: 2477 - DNA, 25 bp, Homo sapiens
cgtgcatccttagtgaacttctgtt

SEQ ID NO: 2478 - DNA, 25 bp, Homo sapiens
tccttagtgaacttctgttgtcctc

SEQ ID NO: 2479 - DNA, 25 bp, Homo sapiens
ttagtgaacttctgttgtcctcaag

SEQ ID NO: 2480 - DNA, 25 bp, Homo sapiens
gtgaacttctgttgtcctcaagcat

SEQ ID NO: 2481 - DNA, 25 bp, Homo sapiens
caagcatggtctttctacttgtaaa

SEQ ID NO: 2482 - DNA, 25 bp, Homo sapiens
tggtctttctacttgtaaactatgg

SEQ ID NO: 2483 - DNA, 25 bp, Homo sapiens
ttctacttgtaaactatggtgctca

SEQ ID NO: 2484 - DNA, 25 bp, Homo sapiens
gtaaactatggtgctcagttttgcc

SEQ ID NO: 2485 - DNA, 25 bp, Homo sapiens
aaactatggtgctcagttttgcctc

SEQ ID NO: 2486 - DNA, 25 bp, Homo sapiens
atggtgctcagttttgcctctgtta

SEQ ID NO: 2487 - DNA, 25 bp, Homo sapiens
agttttgcctctgttagaaattcac

SEQ ID NO: 2488 - DNA, 25 bp, Homo sapiens
gttttgcctctgttagaaattcaca

SEQ ID NO: 2489 - DNA, 25 bp, Homo sapiens
ttgcctctgttagaaattcacactg

SEQ ID NO: 2490 - DNA, 25 bp, Homo sapiens
gcctctgttagaaattcacactgtt

SEQ ID NO: 2491 - DNA, 25 bp, Homo sapiens
aatgatgtggaactcctctaaaaat

SEQ ID NO: 2492 - DNA, 25 bp, Homo sapiens
ctaattcatgttgtagcacttacag

SEQ ID NO: 2493 - DNA, 25 bp, Homo sapiens
taattcatgttgtagcacttacaga

SEQ ID NO: 2494 - DNA, 25 bp, Homo sapiens
aattcatgttgtagcacttacagat

SEQ ID NO: 2495 - DNA, 25 bp, Homo sapiens
attcatgttgtagcacttacagatc

SEQ ID NO: 2496 - DNA, 25 bp, Homo sapiens
ttcatgttgtagcacttacagatca

SEQ ID NO: 2497 - DNA, 25 bp, Homo sapiens
tgttgtagcacttacagatcatata

SEQ ID NO: 2498 - DNA, 25 bp, Homo sapiens
gttgtagcacttacagatcatatag

SEQ ID NO: 2499 - DNA, 25 bp, Homo sapiens
ttgtagcacttacagatcatatagt

SEQ ID NO: 2500 - DNA, 25 bp, Homo sapiens
tgtagcacttacagatcatatagta

SEQ ID NO: 2501 - DNA, 25 bp, Homo sapiens
gtagcacttacagatcatatagtac

SEQ ID NO: 2502 - DNA, 25 bp, Homo sapiens
tttcacccctatggataggttttca

SEQ ID NO: 2503 - DNA, 25 bp, Homo sapiens
ttcacccctatggataggttttcac

SEQ ID NO: 2504 - DNA, 25 bp, Homo sapiens
tcacccctatggataggttttcacc

SEQ ID NO: 2505 - DNA, 25 bp, Homo sapiens
cacccctatggataggttttcacct

SEQ ID NO: 2506 - DNA, 25 bp, Homo sapiens
acccctatggataggttttcacctg

SEQ ID NO: 2507 - DNA, 25 bp, Homo sapiens
cccctatggataggttttcacctgt

SEQ ID NO: 2508 - DNA, 25 bp, Homo sapiens
ctgggatcagacaccccttcacgtg

SEQ ID NO: 2509 - DNA, 25 bp, Homo sapiens
ccacacaaatgcaagctcaccaagg

SEQ ID NO: 2510 - DNA, 25 bp, Homo sapiens
cacaaatgcaagctcaccaaggtcc

SEQ ID NO: 2511 - DNA, 25 bp, Homo sapiens
aaatgcaagctcaccaaggtcccct

SEQ ID NO: 2512 - DNA, 25 bp, Homo sapiens
acccgccatgggagtgtgctcagga

SEQ ID NO: 2513 - DNA, 25 bp, Homo sapiens
cagaatctccaatagaggactgagc

SEQ ID NO: 2514 - DNA, 25 bp, Homo sapiens
atctccaatagaggactgagcactg

SEQ ID NO: 2515 - DNA, 25 bp, Homo sapiens
caccgcgggatttcggacgaggatt

SEQ ID NO: 2516 - DNA, 25 bp, Homo sapiens
ctcgctcagggatccccctttgagg

SEQ ID NO: 2517 - DNA, 25 bp, Homo sapiens
ttagggtcccagttcccagtggaag

SEQ ID NO: 2518 - DNA, 25 bp, Homo sapiens
ccagttcccagtggaagaaacaggc

SEQ ID NO: 2519 - DNA, 25 bp, Homo sapiens
ttcccagtggaagaaacaggccagg

SEQ ID NO: 2520 - DNA, 25 bp, Homo sapiens
cgtgccgagctgaggcagatgttcc

SEQ ID NO: 2521 - DNA, 25 bp, Homo sapiens
tgaggcagatgttcccacagtgacc

SEQ ID NO: 2522 - DNA, 25 bp, Homo sapiens
gaagaggccctgagtcctgggatca

SEQ ID NO: 2523 - DNA, 25 bp, Homo sapiens
agtcctgggatcagacaccccttca

SEQ ID NO: 2524 - DNA, 25 bp, Homo sapiens
cctgtctgcatctgactgagcagaa

SEQ ID NO: 2525 - DNA, 25 bp, Homo sapiens
ctgtctgcatctgactgagcagaac

SEQ ID NO: 2526 - DNA, 25 bp, Homo sapiens
gtctgcatctgactgagcagaacaa

SEQ ID NO: 2527 - DNA, 25 bp, Homo sapiens
ctgcatctgactgagcagaacaaat

SEQ ID NO: 2528 - DNA, 25 bp, Homo sapiens
gcatctgactgagcagaacaaatcg

SEQ ID NO: 2529 - DNA, 25 bp, Homo sapiens
catctgactgagcagaacaaatcgt

SEQ ID NO: 2530 - DNA, 25 bp, Homo sapiens
atctgactgagcagaacaaatcgtc

SEQ ID NO: 2531 - DNA, 25 bp, Homo sapiens
agcagaacaaatcgtcaggtgcctg

SEQ ID NO: 2532 - DNA, 25 bp, Homo sapiens
cagaacaaatcgtcaggtgcctgga

SEQ ID NO: 2533 - DNA, 25 bp, Homo sapiens
agaacaaatcgtcaggtgcctggag

SEQ ID NO: 2534 - DNA, 25 bp, Homo sapiens
gaacaaatcgtcaggtgcctggagc

SEQ ID NO: 2535 - DNA, 25 bp, Homo sapiens
caaatcgtcaggtgcctggagcaaa

SEQ ID NO: 2536 - DNA, 25 bp, Homo sapiens
tcgtcaggtgcctggagcaaaaagg

SEQ ID NO: 2537 - DNA, 25 bp, Homo sapiens
cgtcaggtgcctggagcaaaaagga

SEQ ID NO: 2538 - DNA, 25 bp, Homo sapiens
gtcaggtgcctggagcaaaaaggaa

SEQ ID NO: 2539 - DNA, 25 bp, Homo sapiens
tcaggtgcctggagcaaaaaggaaa

SEQ ID NO: 2540 - DNA, 25 bp, Homo sapiens
ggaaggcacgaagtctctaaagcat

SEQ ID NO: 2541 - DNA, 25 bp, Homo sapiens
aaggcacgaagtctctaaagcatcc

SEQ ID NO: 2542 - DNA, 25 bp, Homo sapiens
aggcacgaagtctctaaagcatcca

SEQ ID NO: 2543 - DNA, 25 bp, Homo sapiens
gcacgaagtctctaaagcatccaga

SEQ ID NO: 2544 - DNA, 25 bp, Homo sapiens
cacgaagtctctaaagcatccagaa

SEQ ID NO: 2545 - DNA, 25 bp, Homo sapiens
acgaagtctctaaagcatccagaag

SEQ ID NO: 2546 - DNA, 25 bp, Homo sapiens
cgaagtctctaaagcatccagaaga

SEQ ID NO: 2547 - DNA, 25 bp, Homo sapiens
gaagtctctaaagcatccagaagac

SEQ ID NO: 2548 - DNA, 25 bp, Homo sapiens
aagtctctaaagcatccagaagacc

SEQ ID NO: 2549 - DNA, 25 bp, Homo sapiens
agtctctaaagcatccagaagaccc

SEQ ID NO: 2550 - DNA, 25 bp, Homo sapiens
gtctctaaagcatccagaagacccc

SEQ ID NO: 2551 - DNA, 25 bp, Homo sapiens
gaagacccctacaccagggtctggt

SEQ ID NO: 2552 - DNA, 25 bp, Homo sapiens
tacaccagggtctggtccgctccta

SEQ ID NO: 2553 - DNA, 25 bp, Homo sapiens
acaccagggtctggtccgctcctat

SEQ ID NO: 2554 - DNA, 25 bp, Homo sapiens
caccagggtctggtccgctcctatt

SEQ ID NO: 2555 - DNA, 25 bp, Homo sapiens
accagggtctggtccgctcctattc

SEQ ID NO: 2556 - DNA, 25 bp, Homo sapiens
cccggagtgcttatcttaaaattgc

SEQ ID NO: 2557 - DNA, 25 bp, Homo sapiens
aaattgcagatttagggagcctgcc

SEQ ID NO: 2558 - DNA, 25 bp, Homo sapiens
atttagggagcctgccaatttaaca

SEQ ID NO: 2559 - DNA, 25 bp, Homo sapiens
caggtgattcttttcaacagtaatg

SEQ ID NO: 2560 - DNA, 25 bp, Homo sapiens
aggtgctttaaggttgccctctgcc

SEQ ID NO: 2561 - DNA, 25 bp, Homo sapiens
gccctctgccgatactgtttgtctt

SEQ ID NO: 2562 - DNA, 25 bp, Homo sapiens
tgccgatactgtttgtctttctact

SEQ ID NO: 2563 - DNA, 25 bp, Homo sapiens
ccgatactgtttgtctttctactgt

SEQ ID NO: 2564 - DNA, 25 bp, Homo sapiens
ctagaactatagatccacatgaacg

SEQ ID NO: 2565 - DNA, 25 bp, Homo sapiens
actatagatccacatgaacgcacgc

SEQ ID NO: 2566 - DNA, 25 bp, Homo sapiens
tggattgcctaggaaagcaagtcat

SEQ ID NO: 2567 - DNA, 25 bp, Homo sapiens
gattgcctaggaaagcaagtcatat

SEQ ID NO: 2568 - DNA, 25 bp, Homo sapiens
agtcatatggccattgatagttctc

SEQ ID NO: 2569 - DNA, 25 bp, Homo sapiens
tggccattgatagttctcatgtaat

SEQ ID NO: 2570 - DNA, 25 bp, Homo sapiens
agttctcatgtaattagttttgctc

SEQ ID NO: 2571 - DNA, 25 bp, Homo sapiens
ttgctcaccactagtacagatgacc

SEQ ID NO: 2572 - DNA, 25 bp, Homo sapiens
atagacgtcttttcccgatattcgg

SEQ ID NO: 2573 - DNA, 25 bp, Homo sapiens
ttttcccgatattcgggcagcgagg

SEQ ID NO: 2574 - DNA, 25 bp, Homo sapiens
gcagcgagggcagcacgcagaccct

SEQ ID NO: 2575 - DNA, 25 bp, Homo sapiens
gcacgcagaccctgaccaaggggga

SEQ ID NO: 2576 - DNA, 25 bp, Homo sapiens
agctaccaggcttcctgcagagtgg

SEQ ID NO: 2577 - DNA, 25 bp, Homo sapiens
ccaggcttcctgcagagtggaaaag

SEQ ID NO: 2578 - DNA, 25 bp, Homo sapiens
gcttcctgcagagtggaaaagacaa

SEQ ID NO: 2579 - DNA, 25 bp, Homo sapiens
tcaaggacctggacgccaatggaga

SEQ ID NO: 2580 - DNA, 25 bp, Homo sapiens
caggtggacttcagtgagttcatcg

SEQ ID NO: 2581 - DNA, 25 bp, Homo sapiens
gacttcagtgagttcatcgtgttcg

SEQ ID NO: 2582 - DNA, 25 bp, Homo sapiens
cttcagtgagttcatcgtgttcgtg

SEQ ID NO: 2583 - DNA, 25 bp, Homo sapiens
tgtcacaagtactttgagaaggcag

SEQ ID NO: 2584 - DNA, 25 bp, Homo sapiens
agtactttgagaaggcaggactcaa

SEQ ID NO: 2585 - DNA, 25 bp, Homo sapiens
tgttggcaattattcccctaggctg

SEQ ID NO: 2586 - DNA, 25 bp, Homo sapiens
caccatgacggaactagagacagcc

SEQ ID NO: 2587 - DNA, 25 bp, Homo sapiens
atgatcatagacgtcttttcccgat

SEQ ID NO: 2588 - DNA, 25 bp, Homo sapiens
cctctccgagcgtaagaagcctctg

SEQ ID NO: 2589 - DNA, 25 bp, Homo sapiens
cgtaagaagcctctggacattgact

SEQ ID NO: 2590 - DNA, 25 bp, Homo sapiens
gagaaagcccaggagctgtcggact

SEQ ID NO: 2591 - DNA, 25 bp, Homo sapiens
aaagcccaggagctgtcggactgga

SEQ ID NO: 2592 - DNA, 25 bp, Homo sapiens
aagcccaggagctgtcggactggat

SEQ ID NO: 2593 - DNA, 25 bp, Homo sapiens
gcccaggagctgtcggactggatcc

SEQ ID NO: 2594 - DNA, 25 bp, Homo sapiens
aggagctgtcggactggatccacca

SEQ ID NO: 2595 - DNA, 25 bp, Homo sapiens
ggagctgtcggactggatccaccag

SEQ ID NO: 2596 - DNA, 25 bp, Homo sapiens
ctgtcggactggatccaccagctgg

SEQ ID NO: 2597 - DNA, 25 bp, Homo sapiens
tcggactggatccaccagctggagt

SEQ ID NO: 2598 - DNA, 25 bp, Homo sapiens
cggactggatccaccagctggagtc

SEQ ID NO: 2599 - DNA, 25 bp, Homo sapiens
ggactggatccaccagctggagtct

SEQ ID NO: 2600 - DNA, 25 bp, Homo sapiens
actggatccaccagctggagtctga

SEQ ID NO: 2601 - DNA, 25 bp, Homo sapiens
gcctgggagtgtttgtcccatcggt

SEQ ID NO: 2602 - DNA, 25 bp, Homo sapiens
gtgtttgtcccatcggtagcttgaa

SEQ ID NO: 2603 - DNA, 25 bp, Homo sapiens
tgtcccatcggtagcttgaaataaa

SEQ ID NO: 2604 - DNA, 25 bp, Homo sapiens
caatagcaaacaacggaagagacgg

SEQ ID NO: 2605 - DNA, 25 bp, Homo sapiens
gcaaacaacggaagagacgggcaga

SEQ ID NO: 2606 - DNA, 25 bp, Homo sapiens
caaacaacggaagagacgggcagag

SEQ ID NO: 2607 - DNA, 25 bp, Homo sapiens
agagacgggcagagttgaagcaaca

SEQ ID NO: 2608 - DNA, 25 bp, Homo sapiens
ctttatagaatgtcaaccaaagagt

SEQ ID NO: 2609 - DNA, 25 bp, Homo sapiens
ttatagaatgtcaaccaaagagtgc

SEQ ID NO: 2610 - DNA, 25 bp, Homo sapiens
gaatgtcaaccaaagagtgccctcc

SEQ ID NO: 2611 - DNA, 25 bp, Homo sapiens
aatgtcaaccaaagagtgccctcct

SEQ ID NO: 2612 - DNA, 25 bp, Homo sapiens
catctcatcacaacgcatgtctgtg

SEQ ID NO: 2613 - DNA, 25 bp, Homo sapiens
acaacgcatgtctgtgacctttggt

SEQ ID NO: 2614 - DNA, 25 bp, Homo sapiens
atgtctgtgacctttggtaatcatt

SEQ ID NO: 2615 - DNA, 25 bp, Homo sapiens
gtgacctttggtaatcatttacagt

SEQ ID NO: 2616 - DNA, 25 bp, Homo sapiens
gtaatcatttacagtgccacacgga

SEQ ID NO: 2617 - DNA, 25 bp, Homo sapiens
agtgccacacggaaccctgtatttt

SEQ ID NO: 2618 - DNA, 25 bp, Homo sapiens
gtgccacacggaaccctgtattttg

SEQ ID NO: 2619 - DNA, 25 bp, Homo sapiens
cacggaaccctgtattttgcacaca

SEQ ID NO: 2620 - DNA, 25 bp, Homo sapiens
tcccagctgcactgcttacacgtct

SEQ ID NO: 2621 - DNA, 25 bp, Homo sapiens
cttacacgtcttccttcgtcttcac

SEQ ID NO: 2622 - DNA, 25 bp, Homo sapiens
agcagcagcaatgagccttcctctg

SEQ ID NO: 2623 - DNA, 25 bp, Homo sapiens
agtctgctttgcagaccgagattgc

SEQ ID NO: 2624 - DNA, 25 bp, Homo sapiens
tagagttcatcctggcagctcaccg

SEQ ID NO: 2625 - DNA, 25 bp, Homo sapiens
cctgggcttcccagaagagatgtct

SEQ ID NO: 2626 - DNA, 25 bp, Homo sapiens
atgtctgtggcttcccttgatctga

SEQ ID NO: 2627 - DNA, 25 bp, Homo sapiens
ccttgatctgactgggggcctgcca

SEQ ID NO: 2628 - DNA, 25 bp, Homo sapiens
cccaagccctcagtggaacctgtca

SEQ ID NO: 2629 - DNA, 25 bp, Homo sapiens
tggaacctgtcaagagcatcagcag

SEQ ID NO: 2630 - DNA, 25 bp, Homo sapiens
agccctttgatgacttcctgttccc

SEQ ID NO: 2631 - DNA, 25 bp, Homo sapiens
ttcctgttcccagcatcatccaggc

SEQ ID NO: 2632 - DNA, 25 bp, Homo sapiens
gacctatctgggtccttctatgcag

SEQ ID NO: 2633 - DNA, 25 bp, Homo sapiens
ctatgcagcagactgggagcctctg

SEQ ID NO: 2634 - DNA, 25 bp, Homo sapiens
gcccatggccacagagctggagccc

SEQ ID NO: 2635 - DNA, 25 bp, Homo sapiens
gagcccctgtgcactccggtggtca

SEQ ID NO: 2636 - DNA, 25 bp, Homo sapiens
ctcaccctaaaactaagcgtgctgc

SEQ ID NO: 2637 - DNA, 25 bp, Homo sapiens
aaactaagcgtgctgcttctgcaaa

SEQ ID NO: 2638 - DNA, 25 bp, Homo sapiens
agcgtgctgcttctgcaaaagattt

SEQ ID NO: 2639 - DNA, 25 bp, Homo sapiens
ctgcttctgcaaaagatttttgtag

SEQ ID NO: 2640 - DNA, 25 bp, Homo sapiens
tttttgtagatgagctgtgtgcctc

SEQ ID NO: 2641 - DNA, 25 bp, Homo sapiens
tttgtagatgagctgtgtgcctcag

SEQ ID NO: 2642 - DNA, 25 bp, Homo sapiens
gtgtgcctcagaattgctatttcaa

SEQ ID NO: 2643 - DNA, 25 bp, Homo sapiens
gcctcagaattgctatttcaaattg

SEQ ID NO: 2644 - DNA, 25 bp, Homo sapiens
tcatttggtcttctaaaatgggatc

SEQ ID NO: 2645 - DNA, 25 bp, Homo sapiens
ttggtcttctaaaatgggatcatgc

SEQ ID NO: 2646 - DNA, 25 bp, Homo sapiens
gggatcatgcccatttagattttcc

SEQ ID NO: 2647 - DNA, 25 bp, Homo sapiens
ggatcatgcccatttagattttcct

SEQ ID NO: 2648 - DNA, 25 bp, Homo sapiens
ttgctcactgcctatttaatgtagc

SEQ ID NO: 2649 - DNA, 25 bp, Homo sapiens
gctcactgcctatttaatgtagcta

SEQ ID NO: 2650 - DNA, 25 bp, Homo sapiens
gcctttaattgttctcataatgaag

SEQ ID NO: 2651 - DNA, 25 bp, Homo sapiens
agtaggtatccctccatgcccttct

SEQ ID NO: 2652 - DNA, 25 bp, Homo sapiens
ctccgtggtgatggaacgcatccgg

SEQ ID NO: 2653 - DNA, 25 bp, Homo sapiens
gcatccggatggacattcgcaaagt

SEQ ID NO: 2654 - DNA, 25 bp, Homo sapiens
gcactggggacctgtttgctgccat

SEQ ID NO: 2655 - DNA, 25 bp, Homo sapiens
tggcgtggacacacaagcaccccaa

SEQ ID NO: 2656 - DNA, 25 bp, Homo sapiens
tggcctgtgagaagaccgtgtctac

SEQ ID NO: 2657 - DNA, 25 bp, Homo sapiens
tgtctaccttgcaccacgttctgca

SEQ ID NO: 2658 - DNA, 25 bp, Homo sapiens
ccttgcaccacgttctgcagaggac

SEQ ID NO: 2659 - DNA, 25 bp, Homo sapiens
accacgttctgcagaggaccatcca

SEQ ID NO: 2660 - DNA, 25 bp, Homo sapiens
agaggaccatccagtgtgcaaaagc

SEQ ID NO: 2661 - DNA, 25 bp, Homo sapiens
ccatccagtgtgcaaaagcccaggc

SEQ ID NO: 2662 - DNA, 25 bp, Homo sapiens
ccagtgtgcaaaagcccaggccggg

SEQ ID NO: 2663 - DNA, 25 bp, Homo sapiens
aaagggacatcgaggacccagagat

SEQ ID NO: 2664 - DNA, 25 bp, Homo sapiens
gggacatcgaggacccagagatcgt

SEQ ID NO: 2665 - DNA, 25 bp, Homo sapiens
tcgaggacccagagatcgtcgtcca

SEQ ID NO: 2666 - DNA, 25 bp, Homo sapiens
agatcgtcgtccaggccacggtgct

SEQ ID NO: 2667 - DNA, 25 bp, Homo sapiens
cccgtgacacgcagcgcgttggtgt

SEQ ID NO: 2668 - DNA, 25 bp, Homo sapiens
aaagtcagtgacatgcccatgcgag

SEQ ID NO: 2669 - DNA, 25 bp, Homo sapiens
agtgacatgcccatgcgagtacctg

SEQ ID NO: 2670 - DNA, 25 bp, Homo sapiens
gtgacatgcccatgcgagtacctga

SEQ ID NO: 2671 - DNA, 25 bp, Homo sapiens
catgcccatgcgagtacctgaggaa

SEQ ID NO: 2672 - DNA, 25 bp, Homo sapiens
gcccatgcgagtacctgaggaaggt

SEQ ID NO: 2673 - DNA, 25 bp, Homo sapiens
ccatgcgagtacctgaggaaggtga

SEQ ID NO: 2674 - DNA, 25 bp, Homo sapiens
gtctcagctgccacacatctcatag

SEQ ID NO: 2675 - DNA, 25 bp, Homo sapiens
agctgccacacatctcatagccggt

SEQ ID NO: 2676 - DNA, 25 bp, Homo sapiens
cacacatctcatagccggtgatgct

SEQ ID NO: 2677 - DNA, 25 bp, Homo sapiens
cttacgcagtcacagtactggcttc

SEQ ID NO: 2678 - DNA, 25 bp, Homo sapiens
ttacgcagtcacagtactggcttct

SEQ ID NO: 2679 - DNA, 25 bp, Homo sapiens
cagtcacagtactggcttcttcctc

SEQ ID NO: 2680 - DNA, 25 bp, Homo sapiens
tttctttccatacaagtggcttagg

SEQ ID NO: 2681 - DNA, 25 bp, Homo sapiens
tttccatacaagtggcttagggatg

SEQ ID NO: 2682 - DNA, 25 bp, Homo sapiens
tggatgaaaaccactatcttctgtc

SEQ ID NO: 2683 - DNA, 25 bp, Homo sapiens
gatgaaaaccactatcttctgtcag

SEQ ID NO: 2684 - DNA, 25 bp, Homo sapiens
cgcctaatgtgtttgagcatcactt

SEQ ID NO: 2685 - DNA, 25 bp, Homo sapiens
gtttgagcatcacttaggagaagtc

SEQ ID NO: 2686 - DNA, 25 bp, Homo sapiens
taggtcaaacccaagttagttcaat

SEQ ID NO: 2687 - DNA, 25 bp, Homo sapiens
ggtttgcagatattctctagtcatt

SEQ ID NO: 2688 - DNA, 25 bp, Homo sapiens
tgcagatattctctagtcatttgtt

SEQ ID NO: 2689 - DNA, 25 bp, Homo sapiens
gcagatattctctagtcatttgtta

SEQ ID NO: 2690 - DNA, 25 bp, Homo sapiens
tttcttcgtgatgacatatcacatg

SEQ ID NO: 2691 - DNA, 25 bp, Homo sapiens
ttcttcgtgatgacatatcacatgt

SEQ ID NO: 2692 - DNA, 25 bp, Homo sapiens
cgtgatgacatatcacatgtcagcc

SEQ ID NO: 2693 - DNA, 25 bp, Homo sapiens
tgacatatcacatgtcagccactgt

SEQ ID NO: 2694 - DNA, 25 bp, Homo sapiens
acatatcacatgtcagccactgtga

SEQ ID NO: 2695 - DNA, 25 bp, Homo sapiens
catatcacatgtcagccactgtgat

SEQ ID NO: 2696 - DNA, 25 bp, Homo sapiens
ccactgtgatagaggctgaggaatc

SEQ ID NO: 2697 - DNA, 25 bp, Homo sapiens
aatgatttcacagtgtgtggtcaac

SEQ ID NO: 2698 - DNA, 25 bp, Homo sapiens
tgtgtggtcaacatttctcatgttg

SEQ ID NO: 2699 - DNA, 25 bp, Homo sapiens
acatttctcatgttgaagctttaag

SEQ ID NO: 2700 - DNA, 25 bp, Homo sapiens
cctactttgagcagtttaaggaagt

SEQ ID NO: 2701 - DNA, 25 bp, Homo sapiens
ggaagttttgcctgaggattgcctg

SEQ ID NO: 2702 - DNA, 25 bp, Homo sapiens
ctgaggattgcctgcctcggtctcg

SEQ ID NO: 2703 - DNA, 25 bp, Homo sapiens
ggattgcctgcctcggtctcgcagt

SEQ ID NO: 2704 - DNA, 25 bp, Homo sapiens
gagtgcatgcgcagcattggaacac

SEQ ID NO: 2705 - DNA, 25 bp, Homo sapiens
catgcgcagcattggaacacgggag

SEQ ID NO: 2706 - DNA, 25 bp, Homo sapiens
cagcattggaacacgggaggtagtc

SEQ ID NO: 2707 - DNA, 25 bp, Homo sapiens
tggaacacgggaggtagtcacccag

SEQ ID NO: 2708 - DNA, 25 bp, Homo sapiens
aggtagtcacccagaaaaacttgag

SEQ ID NO: 2709 - DNA, 25 bp, Homo sapiens
cccagaaaaacttgagcggcctggt

SEQ ID NO: 2710 - DNA, 25 bp, Homo sapiens
acttgagcggcctggtgcccatccg

SEQ ID NO: 2711 - DNA, 25 bp, Homo sapiens
ggcctggtgcccatccgagacttaa

SEQ ID NO: 2712 - DNA, 25 bp, Homo sapiens
atccgagacttaaggctagacccca

SEQ ID NO: 2713 - DNA, 25 bp, Homo sapiens
gttccatccctttattagctctgag

SEQ ID NO: 2714 - DNA, 25 bp, Homo sapiens
ctctgagccccaatttactgattgt

SEQ ID NO: 2715 - DNA, 25 bp, Homo sapiens
ttactgattgtgtggctctttctga

SEQ ID NO: 2716 - DNA, 25 bp, Homo sapiens
cgagcaggtcttcaatgaggctcct

SEQ ID NO: 2717 - DNA, 25 bp, Homo sapiens
cttcaatgaggctcctggcatcagc

SEQ ID NO: 2718 - DNA, 25 bp, Homo sapiens
gaggctcctggcatcagctgcaacc

SEQ ID NO: 2719 - DNA, 25 bp, Homo sapiens
gcatcagctgcaacccagtgcaggg

SEQ ID NO: 2720 - DNA, 25 bp, Homo sapiens
gcctggcccccgatatgttcttctg

SEQ ID NO: 2721 - DNA, 25 bp, Homo sapiens
aaactgcggctgctgctggagaagc

SEQ ID NO: 2722 - DNA, 25 bp, Homo sapiens
gaagctgagcaggttccatgccaag

SEQ ID NO: 2723 - DNA, 25 bp, Homo sapiens
tgagcaccccagctggggccaggct

SEQ ID NO: 2724 - DNA, 25 bp, Homo sapiens
ctgggtcgccctggactgtgtgctc

SEQ ID NO: 2725 - DNA, 25 bp, Homo sapiens
tgggtcgccctggactgtgtgctca

SEQ ID NO: 2726 - DNA, 25 bp, Homo sapiens
ctggactgtgtgctcaggagccctg

SEQ ID NO: 2727 - DNA, 25 bp, Homo sapiens
gccctgggaggctctggagcccact

SEQ ID NO: 2728 - DNA, 25 bp, Homo sapiens
ctggagcccactgtacttgctcttg

SEQ ID NO: 2729 - DNA, 25 bp, Homo sapiens
tgtacttgctcttgatgcctggcgg

SEQ ID NO: 2730 - DNA, 25 bp, Homo sapiens
gtacttgctcttgatgcctggcggg

SEQ ID NO: 2731 - DNA, 25 bp, Homo sapiens
ctgcctctctgcaggtccctaataa

SEQ ID NO: 2732 - DNA, 25 bp, Homo sapiens
acatttcccgcaacaaggagcaggg

SEQ ID NO: 2733 - DNA, 25 bp, Homo sapiens
catttcccgcaacaaggagcagggc

SEQ ID NO: 2734 - DNA, 25 bp, Homo sapiens
ttggctttagccataccagggtgag

SEQ ID NO: 2735 - DNA, 25 bp, Homo sapiens
tggctttagccataccagggtgagt

SEQ ID NO: 2736 - DNA, 25 bp, Homo sapiens
ggctttagccataccagggtgagtt

SEQ ID NO: 2737 - DNA, 25 bp, Homo sapiens
gctttagccataccagggtgagtta

SEQ ID NO: 2738 - DNA, 25 bp, Homo sapiens
ctttagccataccagggtgagttaa

SEQ ID NO: 2739 - DNA, 25 bp, Homo sapiens
gccataccagggtgagttaaagaga

SEQ ID NO: 2740 - DNA, 25 bp, Homo sapiens
ccataccagggtgagttaaagagag

SEQ ID NO: 2741 - DNA, 25 bp, Homo sapiens
ctgttaataaacagctctaacacgg

SEQ ID NO: 2742 - DNA, 25 bp, Homo sapiens
tgttaataaacagctctaacacggc

SEQ ID NO: 2743 - DNA, 25 bp, Homo sapiens
gttaataaacagctctaacacggcc

SEQ ID NO: 2744 - DNA, 25 bp, Homo sapiens
taataaacagctctaacacggccag

SEQ ID NO: 2745 - DNA, 25 bp, Homo sapiens
taaacagctctaacacggccaggct

SEQ ID NO: 2746 - DNA, 25 bp, Homo sapiens
aacagctctaacacggccaggctgg

SEQ ID NO: 2747 - DNA, 25 bp, Homo sapiens
tctaacacggccaggctgggctctg

SEQ ID NO: 2748 - DNA, 25 bp, Homo sapiens
ctagtccgggacatccgacgacggg

SEQ ID NO: 2749 - DNA, 25 bp, Homo sapiens
aagctggaaaccattgtgcagctgg

SEQ ID NO: 2750 - DNA, 25 bp, Homo sapiens
agctggaaaccattgtgcagctgga

SEQ ID NO: 2751 - DNA, 25 bp, Homo sapiens
agctggagcggctgaccaatgaacg

SEQ ID NO: 2752 - DNA, 25 bp, Homo sapiens
cagaccggaccctggaggtcatgcg

SEQ ID NO: 2753 - DNA, 25 bp, Homo sapiens
cggaccctggaggtcatgcgccaac

SEQ ID NO: 2754 - DNA, 25 bp, Homo sapiens
cgccaacagctgacagagctgtacc

SEQ ID NO: 2755 - DNA, 25 bp, Homo sapiens
agagctgtaccgtgacattttccag

SEQ ID NO: 2756 - DNA, 25 bp, Homo sapiens
caggcaacagctactctcctgaaga

SEQ ID NO: 2757 - DNA, 25 bp, Homo sapiens
acgcgctgcaacaggctgccgatgg

SEQ ID NO: 2758 - DNA, 25 bp, Homo sapiens
atggaggccacagactgagctggcc

SEQ ID NO: 2759 - DNA, 25 bp, Homo sapiens
tgatgggatttccttcattcccttc

SEQ ID NO: 2760 - DNA, 25 bp, Homo sapiens
accctgagtcccagaaggagctgag

SEQ ID NO: 2761 - DNA, 25 bp, Homo sapiens
agttctctagaccagaagaggatga

SEQ ID NO: 2762 - DNA, 25 bp, Homo sapiens
ttccaaggtgtgttcaaagaggctt

SEQ ID NO: 2763 - DNA, 25 bp, Homo sapiens
gtctaagctttggtctataaagtgc

SEQ ID NO: 2764 - DNA, 25 bp, Homo sapiens
caatgcctgtttattcaccatcaac

SEQ ID NO: 2765 - DNA, 25 bp, Homo sapiens
caaagaagaccacacactgggaaac

SEQ ID NO: 2766 - DNA, 25 bp, Homo sapiens
cacactgggaaacatcattaaatca

SEQ ID NO: 2767 - DNA, 25 bp, Homo sapiens
taaatcacaactcctaaaagacccg

SEQ ID NO: 2768 - DNA, 25 bp, Homo sapiens
gcaagtgctatttgctggctacaaa

SEQ ID NO: 2769 - DNA, 25 bp, Homo sapiens
gcacaagatcatcatccgagtgcag

SEQ ID NO: 2770 - DNA, 25 bp, Homo sapiens
gatcatcatccgagtgcagaccacg

SEQ ID NO: 2771 - DNA, 25 bp, Homo sapiens
ggaagcctttaccaacgccatcacc

SEQ ID NO: 2772 - DNA, 25 bp, Homo sapiens
catcagtgagctgtccctgctggag

SEQ ID NO: 2773 - DNA, 25 bp, Homo sapiens
tgagctgtccctgctggaggagcgc

SEQ ID NO: 2774 - DNA, 25 bp, Homo sapiens
gtccctgctggaggagcgctttcgg

SEQ ID NO: 2775 - DNA, 25 bp, Homo sapiens
gctcggcctgtgagccccgttccta

SEQ ID NO: 2776 - DNA, 25 bp, Homo sapiens
cctgtgagccccgttcctacctgtg

SEQ ID NO: 2777 - DNA, 25 bp, Homo sapiens
gctccaggtaccacaccgaggagag

SEQ ID NO: 2778 - DNA, 25 bp, Homo sapiens
aggagagcggccggtcccagccatg

SEQ ID NO: 2779 - DNA, 25 bp, Homo sapiens
ggtcccagccatggcccgccttgtg

SEQ ID NO: 2780 - DNA, 25 bp, Homo sapiens
cactcaagagttagagcaggtggct

SEQ ID NO: 2781 - DNA, 25 bp, Homo sapiens
cactgccggccacttggggcagaca

SEQ ID NO: 2782 - DNA, 25 bp, Homo sapiens
ctgccggccacttggggcagacaca

SEQ ID NO: 2783 - DNA, 25 bp, Homo sapiens
gccacttggggcagacacagacacc

SEQ ID NO: 2784 - DNA, 25 bp, Homo sapiens
acttggggcagacacagacacctca

SEQ ID NO: 2785 - DNA, 25 bp, Homo sapiens
ggggcagacacagacacctcaagga

SEQ ID NO: 2786 - DNA, 25 bp, Homo sapiens
ctcaaggatctgtcacggaaggcgt

SEQ ID NO: 2787 - DNA, 25 bp, Homo sapiens
cttgtagacgctccagtccctacta

SEQ ID NO: 2788 - DNA, 25 bp, Homo sapiens
ttgtagacgctccagtccctactac

SEQ ID NO: 2789 - DNA, 25 bp, Homo sapiens
tgtagacgctccagtccctactact

SEQ ID NO: 2790 - DNA, 25 bp, Homo sapiens
gtagacgctccagtccctactactg

SEQ ID NO: 2791 - DNA, 25 bp, Homo sapiens
tagacgctccagtccctactactgt

SEQ ID NO: 2792 - DNA, 25 bp, Homo sapiens
gctccagtccctactactgtgacgg

SEQ ID NO: 2793 - DNA, 25 bp, Homo sapiens
cctactactgtgacggcatttccat

SEQ ID NO: 2794 - DNA, 25 bp, Homo sapiens
tactgtgacggcatttccatccctc

SEQ ID NO: 2795 - DNA, 25 bp, Homo sapiens
ggaagggaccttgcagggacctctc

SEQ ID NO: 2796 - DNA, 25 bp, Homo sapiens
gatcaactccttgatttaccatgtg

SEQ ID NO: 2797 - DNA, 25 bp, Homo sapiens
atcaactccttgatttaccatgtgg

SEQ ID NO: 2798 - DNA, 25 bp, Homo sapiens
actccttgatttaccatgtggagga

SEQ ID NO: 2799 - DNA, 25 bp, Homo sapiens
cttgatttaccatgtggaggattac

SEQ ID NO: 2800 - DNA, 25 bp, Homo sapiens
atttaccatgtggaggattacaact

SEQ ID NO: 2801 - DNA, 25 bp, Homo sapiens
aaagcaggcagcttgactgcagagt

SEQ ID NO: 2802 - DNA, 25 bp, Homo sapiens
agcaggcagcttgactgcagagtct

SEQ ID NO: 2803 - DNA, 25 bp, Homo sapiens
gcaggcagcttgactgcagagtcta

SEQ ID NO: 2804 - DNA, 25 bp, Homo sapiens
cagcttgactgcagagtctaatcac

SEQ ID NO: 2805 - DNA, 25 bp, Homo sapiens
gcttgactgcagagtctaatcactg

SEQ ID NO: 2806 - DNA, 25 bp, Homo sapiens
gactgcagagtctaatcactgcact

SEQ ID NO: 2807 - DNA, 25 bp, Homo sapiens
ctgcagagtctaatcactgcactgt

SEQ ID NO: 2808 - DNA, 25 bp, Homo sapiens
atcactgcactgttgcttgtggaat

SEQ ID NO: 2809 - DNA, 25 bp, Homo sapiens
actgcactgttgcttgtggaatcta

SEQ ID NO: 2810 - DNA, 25 bp, Homo sapiens
ctgcactgttgcttgtggaatctag

SEQ ID NO: 2811 - DNA, 25 bp, Homo sapiens
cactgttgcttgtggaatctagcat

SEQ ID NO: 2812 - DNA, 25 bp, Homo sapiens
gatcttcgatcagtttttatagcat

SEQ ID NO: 2813 - DNA, 25 bp, Homo sapiens
cagtttttatagcatctatggacat

SEQ ID NO: 2814 - DNA, 25 bp, Homo sapiens
atagcatctatggacatagaaaatc

SEQ ID NO: 2815 - DNA, 25 bp, Homo sapiens
tagcatctatggacatagaaaatca

SEQ ID NO: 2816 - DNA, 25 bp, Homo sapiens
aagacattgttaccattcgtcttgc

SEQ ID NO: 2817 - DNA, 25 bp, Homo sapiens
gacattgttaccattcgtcttgcaa

SEQ ID NO: 2818 - DNA, 25 bp, Homo sapiens
tcgtcttgcaaatttaagacaactg

SEQ ID NO: 2819 - DNA, 25 bp, Homo sapiens
atttaagacaactgaatgaaaagcc

SEQ ID NO: 2820 - DNA, 25 bp, Homo sapiens
ttattctgtcatagatagtaaagcc

SEQ ID NO: 2821 - DNA, 25 bp, Homo sapiens
attctgtcatagatagtaaagcccc

SEQ ID NO: 2822 - DNA, 25 bp, Homo sapiens
ccatctcagtttatttagtcctgag

SEQ ID NO: 2823 - DNA, 25 bp, Homo sapiens
tttagtcctgaggttggcagcatgg

SEQ ID NO: 2824 - DNA, 25 bp, Homo sapiens
tacacaaagagataacgctgtttca

SEQ ID NO: 2825 - DNA, 25 bp, Homo sapiens
cgctgtttcataataaacaggaatt

SEQ ID NO: 2826 - DNA, 25 bp, Homo sapiens
ataggtaaaccagcatatctacctg

SEQ ID NO: 2827 - DNA, 25 bp, Homo sapiens
gcatatctacctgtatttctcagag

SEQ ID NO: 2828 - DNA, 25 bp, Homo sapiens
gctctcatgtctagtgattattacc

SEQ ID NO: 2829 - DNA, 25 bp, Homo sapiens
ttaccattactgcagaactctgtgt

SEQ ID NO: 2830 - DNA, 25 bp, Homo sapiens
tgcccacggagaacaggcacagctg

SEQ ID NO: 2831 - DNA, 25 bp, Homo sapiens
gcccacggagaacaggcacagctgc

SEQ ID NO: 2832 - DNA, 25 bp, Homo sapiens
gaccggcacgtctcctgcttggtct

SEQ ID NO: 2833 - DNA, 25 bp, Homo sapiens
tcctgcttggtctcctgtcttgctc

SEQ ID NO: 2834 - DNA, 25 bp, Homo sapiens
gcattaacagccaacaatgcctgaa

SEQ ID NO: 2835 - DNA, 25 bp, Homo sapiens
agcgtagccttcatggagagtccac

SEQ ID NO: 2836 - DNA, 25 bp, Homo sapiens
gccttcatggagagtccacacgtct

SEQ ID NO: 2837 - DNA, 25 bp, Homo sapiens
atggagagtccacacgtctaggcag

SEQ ID NO: 2838 - DNA, 25 bp, Homo sapiens
taggcaggccagagatttgagttct

SEQ ID NO: 2839 - DNA, 25 bp, Homo sapiens
accagccaatgaataatggtaatca

SEQ ID NO: 2840 - DNA, 25 bp, Homo sapiens
ttcaaatagcattgtgctttatagc

SEQ ID NO: 2841 - DNA, 25 bp, Homo sapiens
tagcattgtgctttatagcacacaa

SEQ ID NO: 2842 - DNA, 25 bp, Homo sapiens
actgtggaacggtgcagagccagaa

SEQ ID NO: 2843 - DNA, 25 bp, Homo sapiens
gagtttgtgacttttcatcttcaaa

SEQ ID NO: 2844 - DNA, 25 bp, Homo sapiens
tccaggctgtacactacaacggtgt

SEQ ID NO: 2845 - DNA, 25 bp, Homo sapiens
gagaacaccttccttagactcaccg

SEQ ID NO: 2846 - DNA, 25 bp, Homo sapiens
ttagctgctttgctcaggaagacat

SEQ ID NO: 2847 - DNA, 25 bp, Homo sapiens
gctttgctcaggaagacattgccat

SEQ ID NO: 2848 - DNA, 25 bp, Homo sapiens
ctcaggaagacattgccatttgtag

SEQ ID NO: 2849 - DNA, 25 bp, Homo sapiens
accttgccatcaagatgccagagaa

SEQ ID NO: 2850 - DNA, 25 bp, Homo sapiens
ttgccatcaagatgccagagaaagc

SEQ ID NO: 2851 - DNA, 25 bp, Homo sapiens
agtcagcctccagaactccctagat

SEQ ID NO: 2852 - DNA, 25 bp, Homo sapiens
atgcccccatggaggactgtgtgat

SEQ ID NO: 2853 - DNA, 25 bp, Homo sapiens
cccatggaggactgtgtgatctcca

SEQ ID NO: 2854 - DNA, 25 bp, Homo sapiens
ccatggaggactgtgtgatctccat

SEQ ID NO: 2855 - DNA, 25 bp, Homo sapiens
accatgtgtgccaagttccagttca

SEQ ID NO: 2856 - DNA, 25 bp, Homo sapiens
cgccaacacatgtggggctccagag

SEQ ID NO: 2857 - DNA, 25 bp, Homo sapiens
cacatgtggggctccagagactcac

SEQ ID NO: 2858 - DNA, 25 bp, Homo sapiens
tccagagactcactgtggaagtgga

SEQ ID NO: 2859 - DNA, 25 bp, Homo sapiens
caatctaaaccaaacatgtgctagg

SEQ ID NO: 2860 - DNA, 25 bp, Homo sapiens
acctgtgcacatcttgctggtggag

SEQ ID NO: 2861 - DNA, 25 bp, Homo sapiens
ggggctttcggctcccacactgatg

SEQ ID NO: 2862 - DNA, 25 bp, Homo sapiens
ttcggctcccacactgatgattctc

SEQ ID NO: 2863 - DNA, 25 bp, Homo sapiens
ccccagctctcgtgtcctggaggaa

SEQ ID NO: 2864 - DNA, 25 bp, Homo sapiens
tgtcctggaggaagagctagctcca

SEQ ID NO: 2865 - DNA, 25 bp, Homo sapiens
agagctagctccagacatgggttga

SEQ ID NO: 2866 - DNA, 25 bp, Homo sapiens
atcacctagaggagctctggctaag

SEQ ID NO: 2867 - DNA, 25 bp, Homo sapiens
ctaaggcacagttttctagaaataa

SEQ ID NO: 2868 - DNA, 25 bp, Homo sapiens
cgaagcttagcctgtaggtgccaag

SEQ ID NO: 2869 - DNA, 25 bp, Homo sapiens
cctactcttggctgcggccacgtga

SEQ ID NO: 2870 - DNA, 25 bp, Homo sapiens
agcactagtggacaaagccagcaaa

SEQ ID NO: 2871 - DNA, 25 bp, Homo sapiens
tggacaaagccagcaaatgcggcgt

SEQ ID NO: 2872 - DNA, 25 bp, Homo sapiens
gcaaatgcggcgttcctgtgagcag

SEQ ID NO: 2873 - DNA, 25 bp, Homo sapiens
gcggcgttcctgtgagcagataccc

SEQ ID NO: 2874 - DNA, 25 bp, Homo sapiens
ctcaaccagccagctgtcaaaagta

SEQ ID NO: 2875 - DNA, 25 bp, Homo sapiens
cagccagctgtcaaaagtatttcaa

SEQ ID NO: 2876 - DNA, 25 bp, Homo sapiens
cctagtcagagagtgcctggcagag

SEQ ID NO: 2877 - DNA, 25 bp, Homo sapiens
atcccgagttgcactaaccatcctg

SEQ ID NO: 2878 - DNA, 25 bp, Homo sapiens
tcccgagttgcactaaccatcctgg

SEQ ID NO: 2879 - DNA, 25 bp, Homo sapiens
cgagttgcactaaccatcctgggct

SEQ ID NO: 2880 - DNA, 25 bp, Homo sapiens
gcactaaccatcctgggcttcctgt

SEQ ID NO: 2881 - DNA, 25 bp, Homo sapiens
ctgggcttcctgtcctgtgtccctt

SEQ ID NO: 2882 - DNA, 25 bp, Homo sapiens
ttcctgtcctgtgtcccttggtggg

SEQ ID NO: 2883 - DNA, 25 bp, Homo sapiens
tccaggaaccaaggagtggccctcc

SEQ ID NO: 2884 - DNA, 25 bp, Homo sapiens
aggaaccaaggagtggccctccagg

SEQ ID NO: 2885 - DNA, 25 bp, Homo sapiens
gtggccctccaggtggcagcactaa

SEQ ID NO: 2886 - DNA, 25 bp, Homo sapiens
caggtggcagcactaaggacacccc

SEQ ID NO: 2887 - DNA, 25 bp, Homo sapiens
ccccacaacaagagttagcagcgag

SEQ ID NO: 2888 - DNA, 25 bp, Homo sapiens
agttagcagcgaggtccccatgagt

SEQ ID NO: 2889 - DNA, 25 bp, Homo sapiens
tgtgtgtcttttgctaaatatgccc

SEQ ID NO: 2890 - DNA, 25 bp, Homo sapiens
gtgtgtcttttgctaaatatgccct

SEQ ID NO: 2891 - DNA, 25 bp, Homo sapiens
gtgtcttttgctaaatatgcccttt

SEQ ID NO: 2892 - DNA, 25 bp, Homo sapiens
ggttgccttctcatcctccaggcag

SEQ ID NO: 2893 - DNA, 25 bp, Homo sapiens
gttgccttctcatcctccaggcagt

SEQ ID NO: 2894 - DNA, 25 bp, Homo sapiens
tctccttccaataaggcccggtagg

SEQ ID NO: 2895 - DNA, 25 bp, Homo sapiens
cgactcggccaccagcagtgcgtag

SEQ ID NO: 2896 - DNA, 25 bp, Homo sapiens
actcggccaccagcagtgcgtagct

SEQ ID NO: 2897 - DNA, 25 bp, Homo sapiens
tcggccaccagcagtgcgtagctgt

SEQ ID NO: 2898 - DNA, 25 bp, Homo sapiens
ggccaccagcagtgcgtagctgtcg

SEQ ID NO: 2899 - DNA, 25 bp, Homo sapiens
accagcagtgcgtagctgtcgtgca

SEQ ID NO: 2900 - DNA, 25 bp, Homo sapiens
cagtgcgtagctgtcgtgcacctcc

SEQ ID NO: 2901 - DNA, 25 bp, Homo sapiens
agctcccgcacgtcgcgttcgtggg

SEQ ID NO: 2902 - DNA, 25 bp, Homo sapiens
acctccagactgaggccggtcttca

SEQ ID NO: 2903 - DNA, 25 bp, Homo sapiens
actgaggccggtcttcacctgcagg

SEQ ID NO: 2904 - DNA, 25 bp, Homo sapiens
tgaggccggtcttcacctgcaggag

SEQ ID NO: 2905 - DNA, 25 bp, Homo sapiens
aggccggtcttcacctgcaggaggt

SEQ ID NO: 2906 - DNA, 25 bp, Homo sapiens
ggccggtcttcacctgcaggaggtc

SEQ ID NO: 2907 - DNA, 25 bp, Homo sapiens
tcttcacctgcaggaggtcctgata

SEQ ID NO: 2908 - DNA, 25 bp, Homo sapiens
agggagactccacattgtttccatc

SEQ ID NO: 2909 - DNA, 25 bp, Homo sapiens
ggagactccacattgtttccatctc

SEQ ID NO: 2910 - DNA, 25 bp, Homo sapiens
ttatcaaaccatgtagaacaaacgg

SEQ ID NO: 2911 - DNA, 25 bp, Homo sapiens
tatcaaaccatgtagaacaaacggc

SEQ ID NO: 2912 - DNA, 25 bp, Homo sapiens
tcaaaccatgtagaacaaacggctg

SEQ ID NO: 2913 - DNA, 25 bp, Homo sapiens
aaaccatgtagaacaaacggctgtc

SEQ ID NO: 2914 - DNA, 25 bp, Homo sapiens
ccatgtagaacaaacggctgtctgc

SEQ ID NO: 2915 - DNA, 25 bp, Homo sapiens
catgtagaacaaacggctgtctgcc

SEQ ID NO: 2916 - DNA, 25 bp, Homo sapiens
agaacaaacggctgtctgccaactg

SEQ ID NO: 2917 - DNA, 25 bp, Homo sapiens
gaacaaacggctgtctgccaactgg

SEQ ID NO: 2918 - DNA, 25 bp, Homo sapiens
caaacggctgtctgccaactggtag

SEQ ID NO: 2919 - DNA, 25 bp, Homo sapiens
cggctgtctgccaactggtagaggc

SEQ ID NO: 2920 - DNA, 25 bp, Homo sapiens
gctgtctgccaactggtagaggcaa

SEQ ID NO: 2921 - DNA, 25 bp, Homo sapiens
ctgtctgccaactggtagaggcaaa

SEQ ID NO: 2922 - DNA, 25 bp, Homo sapiens
gtctgccaactggtagaggcaaagc

SEQ ID NO: 2923 - DNA, 25 bp, Homo sapiens
ctgccaactggtagaggcaaagcag

SEQ ID NO: 2924 - DNA, 25 bp, Homo sapiens
ccacagaagccaggagcaaatgttt

SEQ ID NO: 2925 - DNA, 25 bp, Homo sapiens
ggagcaaatgtttctgcagtagtct

SEQ ID NO: 2926 - DNA, 25 bp, Homo sapiens
gtagtctctgtgctttgactcacct

SEQ ID NO: 2927 - DNA, 25 bp, Homo sapiens
actggagcatctgactcacaagaag

SEQ ID NO: 2928 - DNA, 25 bp, Homo sapiens
ctcacaagaagaccagactgtggag

SEQ ID NO: 2929 - DNA, 25 bp, Homo sapiens
caagaagaccagactgtggagaaat

SEQ ID NO: 2930 - DNA, 25 bp, Homo sapiens
aattcctgtagcatcttctggagtc

SEQ ID NO: 2931 - DNA, 25 bp, Homo sapiens
tcctgtagcatcttctggagtctcc

SEQ ID NO: 2932 - DNA, 25 bp, Homo sapiens
ttctggagtctccagtggttgctgt

SEQ ID NO: 2933 - DNA, 25 bp, Homo sapiens
agtctccagtggttgctgttgatga

SEQ ID NO: 2934 - DNA, 25 bp, Homo sapiens
ttgctgttgatgaggcctcttggac

SEQ ID NO: 2935 - DNA, 25 bp, Homo sapiens
gcctcttggacctctgctctgaggc

SEQ ID NO: 2936 - DNA, 25 bp, Homo sapiens
ttccagagagtcctctggatggcac

SEQ ID NO: 2937 - DNA, 25 bp, Homo sapiens
ggcaccagaggctgcagaaggccaa

SEQ ID NO: 2938 - DNA, 25 bp, Homo sapiens
gcaccagaggctgcagaaggccaag

SEQ ID NO: 2939 - DNA, 25 bp, Homo sapiens
agctagaaggccacatgtcaccgtg

SEQ ID NO: 2940 - DNA, 25 bp, Homo sapiens
tccaggccaagagtctcagctggcc

SEQ ID NO: 2941 - DNA, 25 bp, Homo sapiens
ggccaagagtctcagctggccgaga

SEQ ID NO: 2942 - DNA, 25 bp, Homo sapiens
aagagtctcagctggccgagagtcc

SEQ ID NO: 2943 - DNA, 25 bp, Homo sapiens
agctggccgagagtccaggccttgc

SEQ ID NO: 2944 - DNA, 25 bp, Homo sapiens
gcagcccggcacagctgctgggagc

SEQ ID NO: 2945 - DNA, 25 bp, Homo sapiens
cagctgctgggagcccttgtgtgtc

SEQ ID NO: 2946 - DNA, 25 bp, Homo sapiens
tgggagcccttgtgtgtctggtcac

SEQ ID NO: 2947 - DNA, 25 bp, Homo sapiens
agcccttgtgtgtctggtcacactt

SEQ ID NO: 2948 - DNA, 25 bp, Homo sapiens
ttgtgtgtctggtcacactttttag

SEQ ID NO: 2949 - DNA, 25 bp, Homo sapiens
gtgtctggtcacactttttaggcgt

SEQ ID NO: 2950 - DNA, 25 bp, Homo sapiens
ctggtcacactttttaggcgtcacg

SEQ ID NO: 2951 - DNA, 25 bp, Homo sapiens
ttttaggcgtcacgccaaaggccag

SEQ ID NO: 2952 - DNA, 25 bp, Homo sapiens
gtcacgccaaaggccagcctcctgg

SEQ ID NO: 2953 - DNA, 25 bp, Homo sapiens
ccaatacccattttggaagcccctg

SEQ ID NO: 2954 - DNA, 25 bp, Homo sapiens
ttggaagcccctgtggccgtgtgga

SEQ ID NO: 2955 - DNA, 25 bp, Homo sapiens
agcccctgtggccgtgtggatgtcg

SEQ ID NO: 2956 - DNA, 25 bp, Homo sapiens
actgtgatcctggactcgctgtagg

SEQ ID NO: 2957 - DNA, 25 bp, Homo sapiens
tcatcaacaccgaaagggacgatga

SEQ ID NO: 2958 - DNA, 25 bp, Homo sapiens
acaccgaaagggacgatgactatgc

SEQ ID NO: 2959 - DNA, 25 bp, Homo sapiens
tcacccagtcctactgggacaccaa

SEQ ID NO: 2960 - DNA, 25 bp, Homo sapiens
ctcagggatactcgggcctttctgt

SEQ ID NO: 2961 - DNA, 25 bp, Homo sapiens
gatactcgggcctttctgtgaaagt

SEQ ID NO: 2962 - DNA, 25 bp, Homo sapiens
ttgtaaactccaccacagggcctgg

SEQ ID NO: 2963 - DNA, 25 bp, Homo sapiens
gcaccctgtggcatgaccctcgtca

SEQ ID NO: 2964 - DNA, 25 bp, Homo sapiens
ctcgtcacataggctggaaagattt

SEQ ID NO: 2965 - DNA, 25 bp, Homo sapiens
aagatttcaccgcctacagatggcg

SEQ ID NO: 2966 - DNA, 25 bp, Homo sapiens
gtctcagccacaggccaaagacggg

SEQ ID NO: 2967 - DNA, 25 bp, Homo sapiens
gccacaggccaaagacgggtttcat

SEQ ID NO: 2968 - DNA, 25 bp, Homo sapiens
agacgggtttcattagagtggtgat

SEQ ID NO: 2969 - DNA, 25 bp, Homo sapiens
aaacctatgctggtggtagactagg

SEQ ID NO: 2970 - DNA, 25 bp, Homo sapiens
atgctggtggtagactagggttgtt

SEQ ID NO: 2971 - DNA, 25 bp, Homo sapiens
tggtgttcttctctgacctgaaata

SEQ ID NO: 2972 - DNA, 25 bp, Homo sapiens
ccctgcaggcggtatccagaggtga

SEQ ID NO: 2973 - DNA, 25 bp, Homo sapiens
gcctgaaatgtttccaggcatgacc

SEQ ID NO: 2974 - DNA, 25 bp, Homo sapiens
tttccaggcatgaccctggagcccg

SEQ ID NO: 2975 - DNA, 25 bp, Homo sapiens
ccctgcctgtgagtgacatcggttc

SEQ ID NO: 2976 - DNA, 25 bp, Homo sapiens
catcggttcaggaggagacagtcag

SEQ ID NO: 2977 - DNA, 25 bp, Homo sapiens
ttcaggaggagacagtcaggaagcc

SEQ ID NO: 2978 - DNA, 25 bp, Homo sapiens
agacagtcaggaagcctcctgctga

SEQ ID NO: 2979 - DNA, 25 bp, Homo sapiens
ctcctgctgagtggtccacattctg

SEQ ID NO: 2980 - DNA, 25 bp, Homo sapiens
ctgagtggtccacattctgctgccc

SEQ ID NO: 2981 - DNA, 25 bp, Homo sapiens
tgagtggtccacattctgctgcccc

SEQ ID NO: 2982 - DNA, 25 bp, Homo sapiens
ttgggctctgcgtcccactgagtct

SEQ ID NO: 2983 - DNA, 25 bp, Homo sapiens
tgagtctcattcctctgtccccgag

SEQ ID NO: 2984 - DNA, 25 bp, Homo sapiens
agccgagctctcctgggccagggtc

SEQ ID NO: 2985 - DNA, 25 bp, Homo sapiens
ctctcctgggccagggtctcgtcag

SEQ ID NO: 2986 - DNA, 25 bp, Homo sapiens
aattgaggttaggaacccggcatgc

SEQ ID NO: 2987 - DNA, 25 bp, Homo sapiens
attgaggttaggaacccggcatgcc

SEQ ID NO: 2988 - DNA, 25 bp, Homo sapiens
aggggcattttgacaccctctctaa

SEQ ID NO: 2989 - DNA, 25 bp, Homo sapiens
tgacaccctctctaagggtgagctg

SEQ ID NO: 2990 - DNA, 25 bp, Homo sapiens
cagctgcttacaaaggagcttgcaa

SEQ ID NO: 2991 - DNA, 25 bp, Homo sapiens
tgcttacaaaggagcttgcaaacac

SEQ ID NO: 2992 - DNA, 25 bp, Homo sapiens
gagcttgcaaacaccatcaagaata

SEQ ID NO: 2993 - DNA, 25 bp, Homo sapiens
aaagctgtcattgatgaaatattcc

SEQ ID NO: 2994 - DNA, 25 bp, Homo sapiens
tccaaggcctggatgctaatcaaga

SEQ ID NO: 2995 - DNA, 25 bp, Homo sapiens
atgctaatcaagatgaacaggtcga

SEQ ID NO: 2996 - DNA, 25 bp, Homo sapiens
atgaacaggtcgactttcaagaatt

SEQ ID NO: 2997 - DNA, 25 bp, Homo sapiens
aggtcgactttcaagaattcatatc

SEQ ID NO: 2998 - DNA, 25 bp, Homo sapiens
ccctggtagccattgcgctgaaggc

SEQ ID NO: 2999 - DNA, 25 bp, Homo sapiens
tagccattgcgctgaaggctgccca

SEQ ID NO: 3000 - DNA, 25 bp, Homo sapiens
ctgtagctccacattcctgtgcatt

SEQ ID NO: 3001 - DNA, 25 bp, Homo sapiens
ctccacattcctgtgcattgagggg

SEQ ID NO: 3002 - DNA, 25 bp, Homo sapiens
attcctgtgcattgaggggttaaca

SEQ ID NO: 3003 - DNA, 25 bp, Homo sapiens
tcctgtgcattgaggggttaacatt

SEQ ID NO: 3004 - DNA, 25 bp, Homo sapiens
tatattaagcagaaatcctgcaatg

SEQ ID NO: 3005 - DNA, 25 bp, Homo sapiens
attaagcagaaatcctgcaatgaaa

SEQ ID NO: 3006 - DNA, 25 bp, Homo sapiens
ttaagcagaaatcctgcaatgaaag

SEQ ID NO: 3007 - DNA, 25 bp, Homo sapiens
aatcctgcaatgaaaggtactatat

SEQ ID NO: 3008 - DNA, 25 bp, Homo sapiens
gtactatatttgctagactctagac

SEQ ID NO: 3009 - DNA, 25 bp, Homo sapiens
ctatatttgctagactctagacaag

SEQ ID NO: 3010 - DNA, 25 bp, Homo sapiens
tatatttgctagactctagacaaga

SEQ ID NO: 3011 - DNA, 25 bp, Homo sapiens
tttgctagactctagacaagatatt

SEQ ID NO: 3012 - DNA, 25 bp, Homo sapiens
gctagactctagacaagatattgta

SEQ ID NO: 3013 - DNA, 25 bp, Homo sapiens
tcttcagtatgatcttgtgctgtgc

SEQ ID NO: 3014 - DNA, 25 bp, Homo sapiens
gtatgatcttgtgctgtgctatccg

SEQ ID NO: 3015 - DNA, 25 bp, Homo sapiens
atgatcttgtgctgtgctatccgca

SEQ ID NO: 3016 - DNA, 25 bp, Homo sapiens
tttagtattcattctgcattgctag

SEQ ID NO: 3017 - DNA, 25 bp, Homo sapiens
gtattcattctgcattgctagataa

SEQ ID NO: 3018 - DNA, 25 bp, Homo sapiens
ttcattctgcattgctagataaaag

SEQ ID NO: 3019 - DNA, 25 bp, Homo sapiens
attctgcattgctagataaaagctg

SEQ ID NO: 3020 - DNA, 25 bp, Homo sapiens
ccagccgcacacaggcctagaggta

SEQ ID NO: 3021 - DNA, 25 bp, Homo sapiens
cgcacacaggcctagaggtaaccaa

SEQ ID NO: 3022 - DNA, 25 bp, Homo sapiens
gcacacaggcctagaggtaaccaat

SEQ ID NO: 3023 - DNA, 25 bp, Homo sapiens
cacaggcctagaggtaaccaataaa

SEQ ID NO: 3024 - DNA, 25 bp, Homo sapiens
acaggcctagaggtaaccaataaag

SEQ ID NO: 3025 - DNA, 25 bp, Homo sapiens
caggcctagaggtaaccaataaagt

SEQ ID NO: 3026 - DNA, 25 bp, Homo sapiens
acacaattaggctggctaacggata

SEQ ID NO: 3027 - DNA, 25 bp, Homo sapiens
ttaggctggctaacggatagtgagc

SEQ ID NO: 3028 - DNA, 25 bp, Homo sapiens
gctggctaacggatagtgagcttgt

SEQ ID NO: 3029 - DNA, 25 bp, Homo sapiens
ctggctaacggatagtgagcttgtg

SEQ ID NO: 3030 - DNA, 25 bp, Homo sapiens
gctaacggatagtgagcttgtgccc

SEQ ID NO: 3031 - DNA, 25 bp, Homo sapiens
taacggatagtgagcttgtgcccct

SEQ ID NO: 3032 - DNA, 25 bp, Homo sapiens
tccaaactccacagtatgggaccct

SEQ ID NO: 3033 - DNA, 25 bp, Homo sapiens
ccaaactccacagtatgggaccctg

SEQ ID NO: 3034 - DNA, 25 bp, Homo sapiens
caaactccacagtatgggaccctgg

SEQ ID NO: 3035 - DNA, 25 bp, Homo sapiens
aactccacagtatgggaccctggag

SEQ ID NO: 3036 - DNA, 25 bp, Homo sapiens
gagccagagcaggtgggtgaggtag

SEQ ID NO: 3037 - DNA, 25 bp, Homo sapiens
agagcaggtgggtgaggtagttgag

SEQ ID NO: 3038 - DNA, 25 bp, Homo sapiens
cttcatcatgtcctccgtgaggggg

SEQ ID NO: 3039 - DNA, 25 bp, Homo sapiens
atcatgtcctccgtgaggggggtgg

SEQ ID NO: 3040 - DNA, 25 bp, Homo sapiens
cctccgtgaggggggtgggcagcca

SEQ ID NO: 3041 - DNA, 25 bp, Homo sapiens
cgtgaggggggtgggcagccattcc

SEQ ID NO: 3042 - DNA, 25 bp, Homo sapiens
tcctcaagggaactcttccccctct

SEQ ID NO: 3043 - DNA, 25 bp, Homo sapiens
ttcttgtagtcctcccccctcctct

SEQ ID NO: 3044 - DNA, 25 bp, Homo sapiens
ccctcctctgtctccttcttcggcc

SEQ ID NO: 3045 - DNA, 25 bp, Homo sapiens
ctcctctgtctccttcttcggcctc

SEQ ID NO: 3046 - DNA, 25 bp, Homo sapiens
cctctgtctccttcttcggcctctt

SEQ ID NO: 3047 - DNA, 25 bp, Homo sapiens
tctgtctccttcttcggcctcttct

SEQ ID NO: 3048 - DNA, 25 bp, Homo sapiens
tctccttcttcggcctcttctttct

SEQ ID NO: 3049 - DNA, 25 bp, Homo sapiens
gcctcttctttctcaagaatcatcc

SEQ ID NO: 3050 - DNA, 25 bp, Homo sapiens
aaaactagcaatctgcaggtagggc

SEQ ID NO: 3051 - DNA, 25 bp, Homo sapiens
tcaagagtcttccttagatcaactt

SEQ ID NO: 3052 - DNA, 25 bp, Homo sapiens
agctttcttgctagccccctagtcg

SEQ ID NO: 3053 - DNA, 25 bp, Homo sapiens
caccaaactagtaactagtggggct

SEQ ID NO: 3054 - DNA, 25 bp, Homo sapiens
atcattattgagtcaccattgacag

SEQ ID NO: 3055 - DNA, 25 bp, Homo sapiens
cattgacaggcactattctaatcag

SEQ ID NO: 3056 - DNA, 25 bp, Homo sapiens
caggcactattctaatcagtagttc

SEQ ID NO: 3057 - DNA, 25 bp, Homo sapiens
aggcactattctaatcagtagttca

SEQ ID NO: 3058 - DNA, 25 bp, Homo sapiens
tactagtcttttcctctaggaaaag

SEQ ID NO: 3059 - DNA, 25 bp, Homo sapiens
ttcctctaggaaaagggatactttg

SEQ ID NO: 3060 - DNA, 25 bp, Homo sapiens
ggccagaggcccattagttgagaaa

SEQ ID NO: 3061 - DNA, 25 bp, Homo sapiens
gaggcccattagttgagaaagtcac

SEQ ID NO: 3062 - DNA, 25 bp, Homo sapiens
aggcccattagttgagaaagtcaca

SEQ ID NO: 3063 - DNA, 25 bp, Homo sapiens
gaaatgacaacaaggccctttaact

SEQ ID NO: 3064 - DNA, 25 bp, Homo sapiens
aacttgtcttctagtttagagacat

SEQ ID NO: 3065 - DNA, 25 bp, Homo sapiens
gagacatccttcatttgacatttag

SEQ ID NO: 3066 - DNA, 25 bp, Homo sapiens
catttagtagaattcctctttggcc

SEQ ID NO: 3067 - DNA, 25 bp, Homo sapiens
aactatggctgttgaggttctcatt

SEQ ID NO: 3068 - DNA, 25 bp, Homo sapiens
gtgtatctttaggtgcaatcacagc

SEQ ID NO: 3069 - DNA, 25 bp, Homo sapiens
gtgcaatcacagcagtcctctcatc

SEQ ID NO: 3070 - DNA, 25 bp, Homo sapiens
caaccctgagccaccgtaattgagc

SEQ ID NO: 3071 - DNA, 25 bp, Homo sapiens
agctttcctttctgttccttgtggc

SEQ ID NO: 3072 - DNA, 25 bp, Homo sapiens
gctaagacagtaagccagtgtgaga

SEQ ID NO: 3073 - DNA, 25 bp, Homo sapiens
tcctcccttgggaagtcagagctgc

SEQ ID NO: 3074 - DNA, 25 bp, Homo sapiens
gaagtcagagctgctgccctgggtc

SEQ ID NO: 3075 - DNA, 25 bp, Homo sapiens
gagctgctgccctgggtcctgcaga

SEQ ID NO: 3076 - DNA, 25 bp, Homo sapiens
tgcagagaaacctggccttcagcag

SEQ ID NO: 3077 - DNA, 25 bp, Homo sapiens
tggccttcagcagacctgtttctct

SEQ ID NO: 3078 - DNA, 25 bp, Homo sapiens
tgacttccgtttgcttttagacctt

SEQ ID NO: 3079 - DNA, 25 bp, Homo sapiens
gtttgcttttagaccttcattctag

SEQ ID NO: 3080 - DNA, 25 bp, Homo sapiens
ctagtcccctaatgaatgtataatg

SEQ ID NO: 3081 - DNA, 25 bp, Homo sapiens
gtgtaggcctttccattccatttat

SEQ ID NO: 3082 - DNA, 25 bp, Homo sapiens
ctgagtgtcctacaataaacttccg

SEQ ID NO: 3083 - DNA, 25 bp, Homo sapiens
gagtgtcctacaataaacttccgta

SEQ ID NO: 3084 - DNA, 25 bp, Homo sapiens
gagctcagcaggagggcaacattca

SEQ ID NO: 3085 - DNA, 25 bp, Homo sapiens
gggcaacattcatccgggtgaccca

SEQ ID NO: 3086 - DNA, 25 bp, Homo sapiens
agtggaagcgtccaaacctgctttt

SEQ ID NO: 3087 - DNA, 25 bp, Homo sapiens
gaagcgtccaaacctgcttttccca

SEQ ID NO: 3088 - DNA, 25 bp, Homo sapiens
gcttctggctgctcctgaatggtgg

SEQ ID NO: 3089 - DNA, 25 bp, Homo sapiens
cttctggctgctcctgaatggtgga

SEQ ID NO: 3090 - DNA, 25 bp, Homo sapiens
gctgctcctgaatggtggaatgctg

SEQ ID NO: 3091 - DNA, 25 bp, Homo sapiens
gctgtgtcctctcttctgtctcctg

SEQ ID NO: 3092 - DNA, 25 bp, Homo sapiens
gggcccagacgcaaggcaccgattg

SEQ ID NO: 3093 - DNA, 25 bp, Homo sapiens
gcaaggcaccgattgggccaacatc

SEQ ID NO: 3094 - DNA, 25 bp, Homo sapiens
tgggccaacatcagagccctgctgc

SEQ ID NO: 3095 - DNA, 25 bp, Homo sapiens
ttgttttgctaccttcctagacagg

SEQ ID NO: 3096 - DNA, 25 bp, Homo sapiens
tagacaggctgatggcaagcctctc

SEQ ID NO: 3097 - DNA, 25 bp, Homo sapiens
ctctcccggcgattagcagacaagt

SEQ ID NO: 3098 - DNA, 25 bp, Homo sapiens
tagcagacaagtcaccttaggaggg

SEQ ID NO: 3099 - DNA, 25 bp, Homo sapiens
tggacaggccggagtcaaagtaact

SEQ ID NO: 3100 - DNA, 25 bp, Homo sapiens
gctgctgaccttacgcctgtatatt

SEQ ID NO: 3101 - DNA, 25 bp, Homo sapiens
tgaccttacgcctgtatattaagcc

SEQ ID NO: 3102 - DNA, 25 bp, Homo sapiens
gaccttacgcctgtatattaagcct

SEQ ID NO: 3103 - DNA, 25 bp, Homo sapiens
acatcatgtgcgtctcttgggatcc

SEQ ID NO: 3104 - DNA, 25 bp, Homo sapiens
tcttgggatccagcaaaagtgttaa

SEQ ID NO: 3105 - DNA, 25 bp, Homo sapiens
ggatccagcaaaagtgttaagccac

SEQ ID NO: 3106 - DNA, 25 bp, Homo sapiens
aagtgttaagccacaatgcccttgt

SEQ ID NO: 3107 - DNA, 25 bp, Homo sapiens
gttaagccacaatgcccttgtgcct

SEQ ID NO: 3108 - DNA, 25 bp, Homo sapiens
gccacaatgcccttgtgccttttaa

SEQ ID NO: 3109 - DNA, 25 bp, Homo sapiens
gtgatttcagcaaatctcatgataa

SEQ ID NO: 3110 - DNA, 25 bp, Homo sapiens
gatttcagcaaatctcatgataaag

SEQ ID NO: 3111 - DNA, 25 bp, Homo sapiens
aaatctcatgataaaggacaaggtc

SEQ ID NO: 3112 - DNA, 25 bp, Homo sapiens
gacaaggtcaagaactccagagcac

SEQ ID NO: 3113 - DNA, 25 bp, Homo sapiens
acaaggtcaagaactccagagcact

SEQ ID NO: 3114 - DNA, 25 bp, Homo sapiens
ggtcaagaactccagagcactgagc

SEQ ID NO: 3115 - DNA, 25 bp, Homo sapiens
aactccagagcactgagcagagagg

SEQ ID NO: 3116 - DNA, 25 bp, Homo sapiens
ctttccgcctctttgagaccaagat

SEQ ID NO: 3117 - DNA, 25 bp, Homo sapiens
tttccgcctctttgagaccaagatc

SEQ ID NO: 3118 - DNA, 25 bp, Homo sapiens
ttccgcctctttgagaccaagatca

SEQ ID NO: 3119 - DNA, 25 bp, Homo sapiens
tccgcctctttgagaccaagatcac

SEQ ID NO: 3120 - DNA, 25 bp, Homo sapiens
gcctctttgagaccaagatcaccca

SEQ ID NO: 3121 - DNA, 25 bp, Homo sapiens
gagaccaagatcacccaagtcctgc

SEQ ID NO: 3122 - DNA, 25 bp, Homo sapiens
ttcgcttggaacctgggaaagaata

SEQ ID NO: 3123 - DNA, 25 bp, Homo sapiens
tcgcttggaacctgggaaagaatat

SEQ ID NO: 3124 - DNA, 25 bp, Homo sapiens
ctcgaatagctggatcgaggagatg

SEQ ID NO: 3125 - DNA, 25 bp, Homo sapiens
tagctggatcgaggagatgccctct

SEQ ID NO: 3126 - DNA, 25 bp, Homo sapiens
gaggagatgccctctgaacgcctgt

SEQ ID NO: 3127 - DNA, 25 bp, Homo sapiens
aggagatgccctctgaacgcctgtg

SEQ ID NO: 3128 - DNA, 25 bp, Homo sapiens
gagatgccctctgaacgcctgtgcc

SEQ ID NO: 3129 - DNA, 25 bp, Homo sapiens
agatgccctctgaacgcctgtgccg

SEQ ID NO: 3130 - DNA, 25 bp, Homo sapiens
gatgccctctgaacgcctgtgccgg

SEQ ID NO: 3131 - DNA, 25 bp, Homo sapiens
cttcctccaggagtatggcactcag

SEQ ID NO: 3132 - DNA, 25 bp, Homo sapiens
cagagagcgcgctcgcccagtgatg

SEQ ID NO: 3133 - DNA, 25 bp, Homo sapiens
gtgatgtgtagcacccttgcaccca

SEQ ID NO: 3134 - DNA, 25 bp, Homo sapiens
tgtagcacccttgcacccaggagga

SEQ ID NO: 3135 - DNA, 25 bp, Homo sapiens
atgctctgggggacctccatctgcc

SEQ ID NO: 3136 - DNA, 25 bp, Homo sapiens
ccgtcatgggctggaactgcctccg

SEQ ID NO: 3137 - DNA, 25 bp, Homo sapiens
gctggaactgcctccgagacgagtc

SEQ ID NO: 3138 - DNA, 25 bp, Homo sapiens
gacgagtccacctgcagcgtggtca

SEQ ID NO: 3139 - DNA, 25 bp, Homo sapiens
gtcgcactatgtgaccacccggaaa

SEQ ID NO: 3140 - DNA, 25 bp, Homo sapiens
tccaccctggctatcatcctgggga

SEQ ID NO: 3141 - DNA, 25 bp, Homo sapiens
tcctggggacgtttgctgcttgctg

SEQ ID NO: 3142 - DNA, 25 bp, Homo sapiens
ggacgtttgctgcttgctggatgcc

SEQ ID NO: 3143 - DNA, 25 bp, Homo sapiens
ccttgatagcggattacacctaccc

SEQ ID NO: 3144 - DNA, 25 bp, Homo sapiens
gtcatatatgctttcagaaaccaag

SEQ ID NO: 3145 - DNA, 25 bp, Homo sapiens
gaaaccaagagatccagaaagcgct

SEQ ID NO: 3146 - DNA, 25 bp, Homo sapiens
tccagaaagcgctctgtctcatttg

SEQ ID NO: 3147 - DNA, 25 bp, Homo sapiens
ttgctgcggctgcatcccgtccagt

SEQ ID NO: 3148 - DNA, 25 bp, Homo sapiens
atcctcagctgactgagtctcagaa

SEQ ID NO: 3149 - DNA, 25 bp, Homo sapiens
ctgagtctcagaatgctcaggacca

SEQ ID NO: 3150 - DNA, 25 bp, Homo sapiens
ctcagaatgctcaggaccaaggtgc

SEQ ID NO: 3151 - DNA, 25 bp, Homo sapiens
atgctcaggaccaaggtgcagagat

SEQ ID NO: 3152 - DNA, 25 bp, Homo sapiens
gccaggagacccagcgatctgagca

SEQ ID NO: 3153 - DNA, 25 bp, Homo sapiens
cctatcactagtgcatgctgtggcc

SEQ ID NO: 3154 - DNA, 25 bp, Homo sapiens
gctgtggccagacagatgacacctt

SEQ ID NO: 3155 - DNA, 25 bp, Homo sapiens
cagatgacaccttttgttatgttga

SEQ ID NO: 3156 - DNA, 25 bp, Homo sapiens
tgaaattaacttgctaggcaaccct

SEQ ID NO: 3157 - DNA, 25 bp, Homo sapiens
acttgctaggcaaccctaaattggg

SEQ ID NO: 3158 - DNA, 25 bp, Homo sapiens
gctaggcaaccctaaattgggaagc

SEQ ID NO: 3159 - DNA, 25 bp, Homo sapiens
tgtctgctctggtgtgatctgaaaa

SEQ ID NO: 3160 - DNA, 25 bp, Homo sapiens
ctctggtgtgatctgaaaaggcgtc

SEQ ID NO: 3161 - DNA, 25 bp, Homo sapiens
ctgaaaaggcgtcttcactgcttta

SEQ ID NO: 3162 - DNA, 25 bp, Homo sapiens
aggcgtcttcactgctttatctcat

SEQ ID NO: 3163 - DNA, 25 bp, Homo sapiens
cactgctttatctcatgatgcttgc

SEQ ID NO: 3164 - DNA, 25 bp, Homo sapiens
caagcaggagcttaagatgggcaag

SEQ ID NO: 3165 - DNA, 25 bp, Homo sapiens
taagatgggcaagacctggggccct

SEQ ID NO: 3166 - DNA, 25 bp, Homo sapiens
gggccctgggcagacgcatcaaagc

SEQ ID NO: 3167 - DNA, 25 bp, Homo sapiens
ctgggcagacgcatcaaagcaggca

SEQ ID NO: 3168 - DNA, 25 bp, Homo sapiens
tcaaagcaggcagaagcaggcatgg

SEQ ID NO: 3169 - DNA, 25 bp, Homo sapiens
cagaagcaggcatggccagcaggaa

SEQ ID NO: 3170 - DNA, 25 bp, Homo sapiens
ccctgggcaagaccaacgtcaagga

SEQ ID NO: 3171 - DNA, 25 bp, Homo sapiens
tgggcaagaccaacgtcaaggacga

SEQ ID NO: 3172 - DNA, 25 bp, Homo sapiens
gtaccgacgccgaggagaccattct

SEQ ID NO: 3173 - DNA, 25 bp, Homo sapiens
cgacgccgaggagaccattcttaac

SEQ ID NO: 3174 - DNA, 25 bp, Homo sapiens
tcttaacgccttcaagatgctggac

SEQ ID NO: 3175 - DNA, 25 bp, Homo sapiens
tcaagatgctggacccggacgggaa

SEQ ID NO: 3176 - DNA, 25 bp, Homo sapiens
aaatcaacaaggagtacatcaagcg

SEQ ID NO: 3177 - DNA, 25 bp, Homo sapiens
aggagtacatcaagcgtctgctgat

SEQ ID NO: 3178 - DNA, 25 bp, Homo sapiens
gatgtcccaggctgacaagatgacg

SEQ ID NO: 3179 - DNA, 25 bp, Homo sapiens
ccaggctgacaagatgacggcggaa

SEQ ID NO: 3180 - DNA, 25 bp, Homo sapiens
gcagagtccccatggcatggagctt

SEQ ID NO: 3181 - DNA, 25 bp, Homo sapiens
agtccccatggcatggagcttacac

SEQ ID NO: 3182 - DNA, 25 bp, Homo sapiens
gcatggagcttacacctgactgact

SEQ ID NO: 3183 - DNA, 25 bp, Homo sapiens
atggagcttacacctgactgactgg

SEQ ID NO: 3184 - DNA, 25 bp, Homo sapiens
tggagcttacacctgactgactgga

SEQ ID NO: 3185 - DNA, 25 bp, Homo sapiens
ggagcttacacctgactgactggag

SEQ ID NO: 3186 - DNA, 25 bp, Homo sapiens
gagcttacacctgactgactggagc

SEQ ID NO: 3187 - DNA, 25 bp, Homo sapiens
gcttacacctgactgactggagccc

SEQ ID NO: 3188 - DNA, 25 bp, Homo sapiens
cccacaaagccttctggacctggaa

SEQ ID NO: 3189 - DNA, 25 bp, Homo sapiens
cacaaagccttctggacctggaaag

SEQ ID NO: 3190 - DNA, 25 bp, Homo sapiens
caaagccttctggacctggaaagcc

SEQ ID NO: 3191 - DNA, 25 bp, Homo sapiens
aaagccttctggacctggaaagcct

SEQ ID NO: 3192 - DNA, 25 bp, Homo sapiens
aagccttctggacctggaaagcctg

SEQ ID NO: 3193 - DNA, 25 bp, Homo sapiens
cttctggacctggaaagcctgggga

SEQ ID NO: 3194 - DNA, 25 bp, Homo sapiens
ttctggacctggaaagcctggggaa

SEQ ID NO: 3195 - DNA, 25 bp, Homo sapiens
ggaaggactgacagaccccaggacc

SEQ ID NO: 3196 - DNA, 25 bp, Homo sapiens
cataattgctgttctgctgaatcaa

SEQ ID NO: 3197 - DNA, 25 bp, Homo sapiens
tgctgttctgctgaatcaaatctct

SEQ ID NO: 3198 - DNA, 25 bp, Homo sapiens
tctgctgaatcaaatctcttccaca

SEQ ID NO: 3199 - DNA, 25 bp, Homo sapiens
gaatcaaatctcttccacatgggtg

SEQ ID NO: 3200 - DNA, 25 bp, Homo sapiens
atgggtgcatttgtagctctggacc

SEQ ID NO: 3201 - DNA, 25 bp, Homo sapiens
gcatttgtagctctggacctgtctc

SEQ ID NO: 3202 - DNA, 25 bp, Homo sapiens
gtagctctggacctgtctctaccta

SEQ ID NO: 3203 - DNA, 25 bp, Homo sapiens
aagacactgaggagatactgaacat

SEQ ID NO: 3204 - DNA, 25 bp, Homo sapiens
ttcaagacttagctcctgttgtcat

SEQ ID NO: 3205 - DNA, 25 bp, Homo sapiens
ttgcccccagatacatggtgatggt

SEQ ID NO: 3206 - DNA, 25 bp, Homo sapiens
ccagatacatggtgatggttagcat

SEQ ID NO: 3207 - DNA, 25 bp, Homo sapiens
ctctcagttctacactgatacactt

SEQ ID NO: 3208 - DNA, 25 bp, Homo sapiens
gttctacactgatacacttgaagga

SEQ ID NO: 3209 - DNA, 25 bp, Homo sapiens
cactgatacacttgaaggaccattt

SEQ ID NO: 3210 - DNA, 25 bp, Homo sapiens
cattgccatagctgactacaaatta

SEQ ID NO: 3211 - DNA, 25 bp, Homo sapiens
gtttctgcatagagtctttatgtcc

SEQ ID NO: 3212 - DNA, 25 bp, Homo sapiens
gggtgcatttctaggacttttctaa

SEQ ID NO: 3213 - DNA, 25 bp, Homo sapiens
gtgcatttctaggacttttctaaca

SEQ ID NO: 3214 - DNA, 25 bp, Homo sapiens
atctgcactttaactgacttaagtg

SEQ ID NO: 3215 - DNA, 25 bp, Homo sapiens
ctgcactttaactgacttaagtggc

SEQ ID NO: 3216 - DNA, 25 bp, Homo sapiens
gcactttaactgacttaagtggcat

SEQ ID NO: 3217 - DNA, 25 bp, Homo sapiens
cactttaactgacttaagtggcatt

SEQ ID NO: 3218 - DNA, 25 bp, Homo sapiens
actttaactgacttaagtggcatta

SEQ ID NO: 3219 - DNA, 25 bp, Homo sapiens
ctttaactgacttaagtggcattaa

SEQ ID NO: 3220 - DNA, 25 bp, Homo sapiens
ttaactgacttaagtggcattaaac

SEQ ID NO: 3221 - DNA, 25 bp, Homo sapiens
taactgacttaagtggcattaaaca

SEQ ID NO: 3222 - DNA, 25 bp, Homo sapiens
aactgacttaagtggcattaaacat

SEQ ID NO: 3223 - DNA, 25 bp, Homo sapiens
ggtacttaaagcttctatggttgac

SEQ ID NO: 3224 - DNA, 25 bp, Homo sapiens
gtacttaaagcttctatggttgaca

SEQ ID NO: 3225 - DNA, 25 bp, Homo sapiens
tacttaaagcttctatggttgacat

SEQ ID NO: 3226 - DNA, 25 bp, Homo sapiens
acttaaagcttctatggttgacatt

SEQ ID NO: 3227 - DNA, 25 bp, Homo sapiens
cttaaagcttctatggttgacattg

SEQ ID NO: 3228 - DNA, 25 bp, Homo sapiens
cctggcacttggactctcctagtga

SEQ ID NO: 3229 - DNA, 25 bp, Homo sapiens
agcctgtttggtggtctcttcacac

SEQ ID NO: 3230 - DNA, 25 bp, Homo sapiens
tttggtggtctcttcacacggacgc

SEQ ID NO: 3231 - DNA, 25 bp, Homo sapiens
ttcacacggacgcgcgtgacacaat

SEQ ID NO: 3232 - DNA, 25 bp, Homo sapiens
cggacgcgcgtgacacaatgctggg

SEQ ID NO: 3233 - DNA, 25 bp, Homo sapiens
caaatatcaaacacggacccataga

SEQ ID NO: 3234 - DNA, 25 bp, Homo sapiens
ccgacaagccttcagccacagggga

SEQ ID NO: 3235 - DNA, 25 bp, Homo sapiens
cagccacaggggagccacacagaga

SEQ ID NO: 3236 - DNA, 25 bp, Homo sapiens
caggggagccacacagagatgtcca

SEQ ID NO: 3237 - DNA, 25 bp, Homo sapiens
agccacacagagatgtccaaactgt

SEQ ID NO: 3238 - DNA, 25 bp, Homo sapiens
atgtccaaactgtcgtgcaaaccca

SEQ ID NO: 3239 - DNA, 25 bp, Homo sapiens
aaactgtcgtgcaaacccagtgaga

SEQ ID NO: 3240 - DNA, 25 bp, Homo sapiens
ggactcagtggacactcagaccagc

SEQ ID NO: 3241 - DNA, 25 bp, Homo sapiens
gaccagctcccagatggccctggac

SEQ ID NO: 3242 - DNA, 25 bp, Homo sapiens
gaaggtcccttattgtggctgatat

SEQ ID NO: 3243 - DNA, 25 bp, Homo sapiens
ctgatattaactgtcaatggttatg

SEQ ID NO: 3244 - DNA, 25 bp, Homo sapiens
ccataaagcacctggatgatctcaa

SEQ ID NO: 3245 - DNA, 25 bp, Homo sapiens
agcacctggatgatctcaagggcac

SEQ ID NO: 3246 - DNA, 25 bp, Homo sapiens
ctcctgggaaatgtgctggtgaccg

SEQ ID NO: 3247 - DNA, 25 bp, Homo sapiens
tggtgaccgttttggcaatccattt

SEQ ID NO: 3248 - DNA, 25 bp, Homo sapiens
ccgttttggcaatccatttcggcaa

SEQ ID NO: 3249 - DNA, 25 bp, Homo sapiens
gttttggcaatccatttcggcaaag

SEQ ID NO: 3250 - DNA, 25 bp, Homo sapiens
tggcaatccatttcggcaaagaatt

SEQ ID NO: 3251 - DNA, 25 bp, Homo sapiens
ttcggcaaagaattcacccctgagg

SEQ ID NO: 3252 - DNA, 25 bp, Homo sapiens
ctcctagtccagacgccatgggtca

SEQ ID NO: 3253 - DNA, 25 bp, Homo sapiens
gtccagacgccatgggtcatttcac

SEQ ID NO: 3254 - DNA, 25 bp, Homo sapiens
acgccatgggtcatttcacagagga

SEQ ID NO: 3255 - DNA, 25 bp, Homo sapiens
atttcacagaggaggacaaggctac

SEQ ID NO: 3256 - DNA, 25 bp, Homo sapiens
aggacaaggctactatcacaagcct

SEQ ID NO: 3257 - DNA, 25 bp, Homo sapiens
aggctactatcacaagcctgtgggg

SEQ ID NO: 3258 - DNA, 25 bp, Homo sapiens
ctatcacaagcctgtggggcaaggt

SEQ ID NO: 3259 - DNA, 25 bp, Homo sapiens
atcacaagcctgtggggcaaggtga

SEQ ID NO: 3260 - DNA, 25 bp, Homo sapiens
gtatcattgacacttcctgcagggt

SEQ ID NO: 3261 - DNA, 25 bp, Homo sapiens
tgacacttcctgcagggtggtccct

SEQ ID NO: 3262 - DNA, 25 bp, Homo sapiens
cagcagctttctagggacagctgga

SEQ ID NO: 3263 - DNA, 25 bp, Homo sapiens
tgactatttcttacgagggttctac

SEQ ID NO: 3264 - DNA, 25 bp, Homo sapiens
tcttacgagggttctacttatttat

SEQ ID NO: 3265 - DNA, 25 bp, Homo sapiens
cttacgagggttctacttatttatg

SEQ ID NO: 3266 - DNA, 25 bp, Homo sapiens
tgtgtttcatcaaacatagctcagt

SEQ ID NO: 3267 - DNA, 25 bp, Homo sapiens
gtgtttcatcaaacatagctcagtc

SEQ ID NO: 3268 - DNA, 25 bp, Homo sapiens
gtcagccaccttgataaatgacagg

SEQ ID NO: 3269 - DNA, 25 bp, Homo sapiens
tcagccaccttgataaatgacaggg

SEQ ID NO: 3270 - DNA, 25 bp, Homo sapiens
agccaccttgataaatgacagggtg

SEQ ID NO: 3271 - DNA, 25 bp, Homo sapiens
atttttatgctgaagtttcccttag

SEQ ID NO: 3272 - DNA, 25 bp, Homo sapiens
ttatgctgaagtttcccttagacat

SEQ ID NO: 3273 - DNA, 25 bp, Homo sapiens
tatgctgaagtttcccttagacatt

SEQ ID NO: 3274 - DNA, 25 bp, Homo sapiens
ttaatgtccattctgcagcgtttct

SEQ ID NO: 3275 - DNA, 25 bp, Homo sapiens
taatgtccattctgcagcgtttctc

SEQ ID NO: 3276 - DNA, 25 bp, Homo sapiens
tgtctgatctgtgctttccagctca

SEQ ID NO: 3277 - DNA, 25 bp, Homo sapiens
tctgatctgtgctttccagctcacc

SEQ ID NO: 3278 - DNA, 25 bp, Homo sapiens
cctctgttcccctagtaagtgcctt

SEQ ID NO: 3279 - DNA, 25 bp, Homo sapiens
ctctgttcccctagtaagtgccttc

SEQ ID NO: 3280 - DNA, 25 bp, Homo sapiens
tcccctagtaagtgccttccatgtc

SEQ ID NO: 3281 - DNA, 25 bp, Homo sapiens
agtgccttccatgtcggcctctaac

SEQ ID NO: 3282 - DNA, 25 bp, Homo sapiens
ttgggcccagggacaccagccaggc

SEQ ID NO: 3283 - DNA, 25 bp, Homo sapiens
gggacaccagccaggctctgtgctg

SEQ ID NO: 3284 - DNA, 25 bp, Homo sapiens
aggctctgtgctgaccctcctgttg

SEQ ID NO: 3285 - DNA, 25 bp, Homo sapiens
ggctctgtgctgaccctcctgttgc

SEQ ID NO: 3286 - DNA, 25 bp, Homo sapiens
gagctttgcatgttccactaacccc

SEQ ID NO: 3287 - DNA, 25 bp, Homo sapiens
agctttgcatgttccactaaccccg

SEQ ID NO: 3288 - DNA, 25 bp, Homo sapiens
tgcatgttccactaaccccgggcgg

SEQ ID NO: 3289 - DNA, 25 bp, Homo sapiens
tggcgcctctgcaagggcagaacac

SEQ ID NO: 3290 - DNA, 25 bp, Homo sapiens
tctgcaagggcagaacactaacctg

SEQ ID NO: 3291 - DNA, 25 bp, Homo sapiens
cagaacactaacctgaccgtgggcg

SEQ ID NO: 3292 - DNA, 25 bp, Homo sapiens
attttacaaactggactggctcagg

SEQ ID NO: 3293 - DNA, 25 bp, Homo sapiens
tacaaactggactggctcaggcagg

SEQ ID NO: 3294 - DNA, 25 bp, Homo sapiens
tatgctcaaggacctggaaacccat

SEQ ID NO: 3295 - DNA, 25 bp, Homo sapiens
tgctcaaggacctggaaacccatgc

SEQ ID NO: 3296 - DNA, 25 bp, Homo sapiens
caaggacctggaaacccatgcttcg

SEQ ID NO: 3297 - DNA, 25 bp, Homo sapiens
ctggaaacccatgcttcgagacaac

SEQ ID NO: 3298 - DNA, 25 bp, Homo sapiens
tggaaacccatgcttcgagacaacg

SEQ ID NO: 3299 - DNA, 25 bp, Homo sapiens
aacccatgcttcgagacaacgtgac

SEQ ID NO: 3300 - DNA, 25 bp, Homo sapiens
cccatgcttcgagacaacgtgactt

SEQ ID NO: 3301 - DNA, 25 bp, Homo sapiens
tgcttcgagacaacgtgactttaat

SEQ ID NO: 3302 - DNA, 25 bp, Homo sapiens
tcgagacaacgtgactttaatggga

SEQ ID NO: 3303 - DNA, 25 bp, Homo sapiens
acccctcttgagtgtcttggggaca

SEQ ID NO: 3304 - DNA, 25 bp, Homo sapiens
cccctcttgagtgtcttggggacag

SEQ ID NO: 3305 - DNA, 25 bp, Homo sapiens
tcttgagtgtcttggggacagctct

SEQ ID NO: 3306 - DNA, 25 bp, Homo sapiens
agtgtcttggggacagctctttcca

SEQ ID NO: 3307 - DNA, 25 bp, Homo sapiens
gtgtcttggggacagctctttccac

SEQ ID NO: 3308 - DNA, 25 bp, Homo sapiens
gaaagttgcattctgctgtttgctt

SEQ ID NO: 3309 - DNA, 25 bp, Homo sapiens
aaagttgcattctgctgtttgcttg

SEQ ID NO: 3310 - DNA, 25 bp, Homo sapiens
aagttgcattctgctgtttgcttgg

SEQ ID NO: 3311 - DNA, 25 bp, Homo sapiens
gttgcattctgctgtttgcttggac

SEQ ID NO: 3312 - DNA, 25 bp, Homo sapiens
ttgcattctgctgtttgcttggaca

SEQ ID NO: 3313 - DNA, 25 bp, Homo sapiens
tgcattctgctgtttgcttggacac

SEQ ID NO: 3314 - DNA, 25 bp, Homo sapiens
cattctgctgtttgcttggacaccg

SEQ ID NO: 3315 - DNA, 25 bp, Homo sapiens
attctgctgtttgcttggacaccgt

SEQ ID NO: 3316 - DNA, 25 bp, Homo sapiens
ttctgctgtttgcttggacaccgta

SEQ ID NO: 3317 - DNA, 25 bp, Homo sapiens
tctgctgtttgcttggacaccgtac

SEQ ID NO: 3318 - DNA, 25 bp, Homo sapiens
tgctgtttgcttggacaccgtacca

SEQ ID NO: 3319 - DNA, 25 bp, Homo sapiens
gctgtttgcttggacaccgtaccac

SEQ ID NO: 3320 - DNA, 25 bp, Homo sapiens
ctgtttgcttggacaccgtaccact

SEQ ID NO: 3321 - DNA, 25 bp, Homo sapiens
gtttgcttggacaccgtaccactga

SEQ ID NO: 3322 - DNA, 25 bp, Homo sapiens
gcttggacaccgtaccactgaacaa

SEQ ID NO: 3323 - DNA, 25 bp, Homo sapiens
cttggacaccgtaccactgaacaaa

SEQ ID NO: 3324 - DNA, 25 bp, Homo sapiens
agaccgccttgtaccggaaaatgct

SEQ ID NO: 3325 - DNA, 25 bp, Homo sapiens
gcaagggtgcctggtccatcccatg

SEQ ID NO: 3326 - DNA, 25 bp, Homo sapiens
gtgcctggtccatcccatggaagtg

SEQ ID NO: 3327 - DNA, 25 bp, Homo sapiens
ccatcccatggaagtggctgtttgg

SEQ ID NO: 3328 - DNA, 25 bp, Homo sapiens
tgtttggggcgactgctgttgcctt

SEQ ID NO: 3329 - DNA, 25 bp, Homo sapiens
actgaggccctctaggaggaaagcc

SEQ ID NO: 3330 - DNA, 25 bp, Homo sapiens
ctgaggccctctaggaggaaagccc

SEQ ID NO: 3331 - DNA, 25 bp, Homo sapiens
gaggccctctaggaggaaagcccag

SEQ ID NO: 3332 - DNA, 25 bp, Homo sapiens
aggccctctaggaggaaagcccaga

SEQ ID NO: 3333 - DNA, 25 bp, Homo sapiens
ggccctctaggaggaaagcccagag

SEQ ID NO: 3334 - DNA, 25 bp, Homo sapiens
gccctctaggaggaaagcccagagg

SEQ ID NO: 3335 - DNA, 25 bp, Homo sapiens
cctctaggaggaaagcccagaggga

SEQ ID NO: 3336 - DNA, 25 bp, Homo sapiens
taggtctccgccagggctggcctca

SEQ ID NO: 3337 - DNA, 25 bp, Homo sapiens
agggctggcctcagtttctcctcaa

SEQ ID NO: 3338 - DNA, 25 bp, Homo sapiens
ggctggcctcagtttctcctcaaca

SEQ ID NO: 3339 - DNA, 25 bp, Homo sapiens
agtttctcctcaacaggcctggggg

SEQ ID NO: 3340 - DNA, 25 bp, Homo sapiens
tacctgggctcaatggtttgaaacc

SEQ ID NO: 3341 - DNA, 25 bp, Homo sapiens
cctgggctcaatggtttgaaaccca

SEQ ID NO: 3342 - DNA, 25 bp, Homo sapiens
ctcaatggtttgaaacccagcacat

SEQ ID NO: 3343 - DNA, 25 bp, Homo sapiens
ggtttgaaacccagcacatcaatat

SEQ ID NO: 3344 - DNA, 25 bp, Homo sapiens
gtttgaaacccagcacatcaatatg

SEQ ID NO: 3345 - DNA, 25 bp, Homo sapiens
atgacctcccagcaatgcaccaatg

SEQ ID NO: 3346 - DNA, 25 bp, Homo sapiens
ctcccagcaatgcaccaatgcaatg

SEQ ID NO: 3347 - DNA, 25 bp, Homo sapiens
gccaagctcctcaatcatagccaag

SEQ ID NO: 3348 - DNA, 25 bp, Homo sapiens
tctctccatatactttgggtatcag

SEQ ID NO: 3349 - DNA, 25 bp, Homo sapiens
ctccatatactttgggtatcagcat

SEQ ID NO: 3350 - DNA, 25 bp, Homo sapiens
atatactttgggtatcagcatctgt

SEQ ID NO: 3351 - DNA, 25 bp, Homo sapiens
atactttgggtatcagcatctgtcc

SEQ ID NO: 3352 - DNA, 25 bp, Homo sapiens
tactttgggtatcagcatctgtcct

SEQ ID NO: 3353 - DNA, 25 bp, Homo sapiens
actttgggtatcagcatctgtcctc

SEQ ID NO: 3354 - DNA, 25 bp, Homo sapiens
tttgggtatcagcatctgtcctcat

SEQ ID NO: 3355 - DNA, 25 bp, Homo sapiens
ggtatcagcatctgtcctcatcagt

SEQ ID NO: 3356 - DNA, 25 bp, Homo sapiens
gagacaatacacattccaactatgg

SEQ ID NO: 3357 - DNA, 25 bp, Homo sapiens
tggagaatggtcctaagctggcaag

SEQ ID NO: 3358 - DNA, 25 bp, Homo sapiens
atggtcctaagctggcaagccgcat

SEQ ID NO: 3359 - DNA, 25 bp, Homo sapiens
tggcaagccgcatcttgagcaaatt

SEQ ID NO: 3360 - DNA, 25 bp, Homo sapiens
caaattaactgatatccagtatgga

SEQ ID NO: 3361 - DNA, 25 bp, Homo sapiens
attgtgatagatttctttggctacc

SEQ ID NO: 3362 - DNA, 25 bp, Homo sapiens
ctacctgtgcataatgtagtttgta

SEQ ID NO: 3363 - DNA, 25 bp, Homo sapiens
agagtgattgtttcttcatgccaga

SEQ ID NO: 3364 - DNA, 25 bp, Homo sapiens
tcataacttggtagtagtaacttac

SEQ ID NO: 3365 - DNA, 25 bp, Homo sapiens
gtaagccatataacatgggattttc

SEQ ID NO: 3366 - DNA, 25 bp, Homo sapiens
tagatggcatcattcttccaggagt

SEQ ID NO: 3367 - DNA, 25 bp, Homo sapiens
gcatcattcttccaggagtgacaag

SEQ ID NO: 3368 - DNA, 25 bp, Homo sapiens
tgacaaggcggtgcattctggacct

SEQ ID NO: 3369 - DNA, 25 bp, Homo sapiens
ggcggtgcattctggacctggcaca

SEQ ID NO: 3370 - DNA, 25 bp, Homo sapiens
tctggacctggcacatcagtgggtg

SEQ ID NO: 3371 - DNA, 25 bp, Homo sapiens
gaacaacttttgtaagcctgaaata

SEQ ID NO: 3372 - DNA, 25 bp, Homo sapiens
cccagttcatttcagccttccagtg

SEQ ID NO: 3373 - DNA, 25 bp, Homo sapiens
ttccagtgctacacccacttcttgg

SEQ ID NO: 3374 - DNA, 25 bp, Homo sapiens
agtgctacacccacttcttggctga

SEQ ID NO: 3375 - DNA, 25 bp, Homo sapiens
tgctacacccacttcttggctgaca

SEQ ID NO: 3376 - DNA, 25 bp, Homo sapiens
ccacttcttggctgacacacttctg

SEQ ID NO: 3377 - DNA, 25 bp, Homo sapiens
cacttcttggctgacacacttctgc

SEQ ID NO: 3378 - DNA, 25 bp, Homo sapiens
acttcttggctgacacacttctgct

SEQ ID NO: 3379 - DNA, 25 bp, Homo sapiens
cttcttggctgacacacttctgctc

SEQ ID NO: 3380 - DNA, 25 bp, Homo sapiens
ttcttggctgacacacttctgctct

SEQ ID NO: 3381 - DNA, 25 bp, Homo sapiens
tcttggctgacacacttctgctcta

SEQ ID NO: 3382 - DNA, 25 bp, Homo sapiens
cttggctgacacacttctgctctaa

SEQ ID NO: 3383 - DNA, 25 bp, Homo sapiens
ttggctgacacacttctgctctaag

SEQ ID NO: 3384 - DNA, 25 bp, Homo sapiens
ggctgacacacttctgctctaagag

SEQ ID NO: 3385 - DNA, 25 bp, Homo sapiens
ctgacacacttctgctctaagagtc

SEQ ID NO: 3386 - DNA, 25 bp, Homo sapiens
tgacacacttctgctctaagagtct

SEQ ID NO: 3387 - DNA, 25 bp, Homo sapiens
gacacacttctgctctaagagtctc

SEQ ID NO: 3388 - DNA, 25 bp, Homo sapiens
gcagagcaggctacgtcctcactga

SEQ ID NO: 3389 - DNA, 25 bp, Homo sapiens
cagagcaggctacgtcctcactgag

SEQ ID NO: 3390 - DNA, 25 bp, Homo sapiens
agagcaggctacgtcctcactgagg

SEQ ID NO: 3391 - DNA, 25 bp, Homo sapiens
gagcaggctacgtcctcactgaggt

SEQ ID NO: 3392 - DNA, 25 bp, Homo sapiens
agcaggctacgtcctcactgaggtg

SEQ ID NO: 3393 - DNA, 25 bp, Homo sapiens
caggctacgtcctcactgaggtgtt

SEQ ID NO: 3394 - DNA, 25 bp, Homo sapiens
ggctacgtcctcactgaggtgttct

SEQ ID NO: 3395 - DNA, 25 bp, Homo sapiens
ctacgtcctcactgaggtgttcttc

SEQ ID NO: 3396 - DNA, 25 bp, Homo sapiens
acgtcctcactgaggtgttcttcat

SEQ ID NO: 3397 - DNA, 25 bp, Homo sapiens
tcactgaggtgttcttcatgagagt

SEQ ID NO: 3398 - DNA, 25 bp, Homo sapiens
tgttcttcatgagagtactagcctc

SEQ ID NO: 3399 - DNA, 25 bp, Homo sapiens
gttcttcatgagagtactagcctcc

SEQ ID NO: 3400 - DNA, 25 bp, Homo sapiens
tccccacagcgcagaggaaacaggc

SEQ ID NO: 3401 - DNA, 25 bp, Homo sapiens
cccacagcgcagaggaaacaggcca

SEQ ID NO: 3402 - DNA, 25 bp, Homo sapiens
cacagcgcagaggaaacaggccagc

SEQ ID NO: 3403 - DNA, 25 bp, Homo sapiens
ccagcccagtgacatgacgttatta

SEQ ID NO: 3404 - DNA, 25 bp, Homo sapiens
tgcatcttctgaggtcaattaaaag

SEQ ID NO: 3405 - DNA, 25 bp, Homo sapiens
acaatttctcactttgcatttagtc

SEQ ID NO: 3406 - DNA, 25 bp, Homo sapiens
catgaaatgcttctttctcagttta

SEQ ID NO: 3407 - DNA, 25 bp, Homo sapiens
ataattagtttagtttgtggcttca

SEQ ID NO: 3408 - DNA, 25 bp, Homo sapiens
tagtttgtggcttcatggaaactcc

SEQ ID NO: 3409 - DNA, 25 bp, Homo sapiens
aagcttcagggttatgtctatgttc

SEQ ID NO: 3410 - DNA, 25 bp, Homo sapiens
agagcaatgagcattccgatgtgat

SEQ ID NO: 3411 - DNA, 25 bp, Homo sapiens
agcattccgatgtgattgatagtca

SEQ ID NO: 3412 - DNA, 25 bp, Homo sapiens
tcaggaactttccaaagtcagccgt

SEQ ID NO: 3413 - DNA, 25 bp, Homo sapiens
agccgtgaattccacagccatgaat

SEQ ID NO: 3414 - DNA, 25 bp, Homo sapiens
attccacagccatgaatttcacagc

SEQ ID NO: 3415 - DNA, 25 bp, Homo sapiens
ccatgaatttcacagccatgaagat

SEQ ID NO: 3416 - DNA, 25 bp, Homo sapiens
acagccatgaagatatgctggttgt

SEQ ID NO: 3417 - DNA, 25 bp, Homo sapiens
atgctggttgtagaccccaaaagta

SEQ ID NO: 3418 - DNA, 25 bp, Homo sapiens
acctgaaatttcgtatttctcatga

SEQ ID NO: 3419 - DNA, 25 bp, Homo sapiens
attagatagtgcatcttctgaggtc

SEQ ID NO: 3420 - DNA, 25 bp, Homo sapiens
gaacagctccgggcccggtctgcct

SEQ ID NO: 3421 - DNA, 25 bp, Homo sapiens
ctccgggcccggtctgcctggctgc

SEQ ID NO: 3422 - DNA, 25 bp, Homo sapiens
tccgggcccggtctgcctggctgcc

SEQ ID NO: 3423 - DNA, 25 bp, Homo sapiens
gggcccggtctgcctggctgcctcc

SEQ ID NO: 3424 - DNA, 25 bp, Homo sapiens
cccggtctgcctggctgcctccatc

SEQ ID NO: 3425 - DNA, 25 bp, Homo sapiens
cggtctgcctggctgcctccatcac

SEQ ID NO: 3426 - DNA, 25 bp, Homo sapiens
ggtctgcctggctgcctccatcaca

SEQ ID NO: 3427 - DNA, 25 bp, Homo sapiens
gtctgcctggctgcctccatcacag

SEQ ID NO: 3428 - DNA, 25 bp, Homo sapiens
gcctggctgcctccatcacagccct

SEQ ID NO: 3429 - DNA, 25 bp, Homo sapiens
cctggctgcctccatcacagccctc

SEQ ID NO: 3430 - DNA, 25 bp, Homo sapiens
gttcgacctgatggcgaagctgaaa

SEQ ID NO: 3431 - DNA, 25 bp, Homo sapiens
cgacctgatggcgaagctgaaacag

SEQ ID NO: 3432 - DNA, 25 bp, Homo sapiens
catcagccacgcccagaagttccgg

SEQ ID NO: 3433 - DNA, 25 bp, Homo sapiens
tcagccacgcccagaagttccggaa

SEQ ID NO: 3434 - DNA, 25 bp, Homo sapiens
gccacgcccagaagttccggaaggg

SEQ ID NO: 3435 - DNA, 25 bp, Homo sapiens
gcccagaagttccggaagggggcag

SEQ ID NO: 3436 - DNA, 25 bp, Homo sapiens
gttttacagtgtttctggcttagaa

SEQ ID NO: 3437 - DNA, 25 bp, Homo sapiens
tttacagtgtttctggcttagaaca

SEQ ID NO: 3438 - DNA, 25 bp, Homo sapiens
gtttctggcttagaacaaaggggct

SEQ ID NO: 3439 - DNA, 25 bp, Homo sapiens
ttctggcttagaacaaaggggctta

SEQ ID NO: 3440 - DNA, 25 bp, Homo sapiens
attaactctacctgcacactgtcct

SEQ ID NO: 3441 - DNA, 25 bp, Homo sapiens
tttgaaatgtcaaccccaagttagt

SEQ ID NO: 3442 - DNA, 25 bp, Homo sapiens
atgttttcaaatgttctccagtcat

SEQ ID NO: 3443 - DNA, 25 bp, Homo sapiens
tttcaaatgttctccagtcattatg

SEQ ID NO: 3444 - DNA, 25 bp, Homo sapiens
tcaaatgttctccagtcattatgtt

SEQ ID NO: 3445 - DNA, 25 bp, Homo sapiens
atatttctgaggagcctgcaacatg

SEQ ID NO: 3446 - DNA, 25 bp, Homo sapiens
gaggagcctgcaacatgccagccac

SEQ ID NO: 3447 - DNA, 25 bp, Homo sapiens
ctggcggatccaagcaaatggccaa

SEQ ID NO: 3448 - DNA, 25 bp, Homo sapiens
cggatccaagcaaatggccaatgag

SEQ ID NO: 3449 - DNA, 25 bp, Homo sapiens
tgtgcacatctgttttgtaactgtt

SEQ ID NO: 3450 - DNA, 25 bp, Homo sapiens
tgcacatctgttttgtaactgttta

SEQ ID NO: 3451 - DNA, 25 bp, Homo sapiens
cacatctgttttgtaactgtttaga

SEQ ID NO: 3452 - DNA, 25 bp, Homo sapiens
atcccatcctgagacctggtgcagg

SEQ ID NO: 3453 - DNA, 25 bp, Homo sapiens
cccatcctgagacctggtgcagggc

SEQ ID NO: 3454 - DNA, 25 bp, Homo sapiens
catcctgagacctggtgcagggcca

SEQ ID NO: 3455 - DNA, 25 bp, Homo sapiens
atcctgagacctggtgcagggccag

SEQ ID NO: 3456 - DNA, 25 bp, Homo sapiens
ggaggcagcggcaccagactcacca

SEQ ID NO: 3457 - DNA, 25 bp, Homo sapiens
gaggcagcggcaccagactcaccag

SEQ ID NO: 3458 - DNA, 25 bp, Homo sapiens
aggcagcggcaccagactcaccagg

SEQ ID NO: 3459 - DNA, 25 bp, Homo sapiens
tcgcctggggcctcctcactagggg

SEQ ID NO: 3460 - DNA, 25 bp, Homo sapiens
gccatgagcgccttcctgcagaaca

SEQ ID NO: 3461 - DNA, 25 bp, Homo sapiens
atgagcgccttcctgcagaacacac

SEQ ID NO: 3462 - DNA, 25 bp, Homo sapiens
gagcgccttcctgcagaacacacag

SEQ ID NO: 3463 - DNA, 25 bp, Homo sapiens
cagaacacacagtgccttatgccac

SEQ ID NO: 3464 - DNA, 25 bp, Homo sapiens
ctttaccctggacagcaggaaacct

SEQ ID NO: 3465 - DNA, 25 bp, Homo sapiens
ttaccctggacagcaggaaacctgt

SEQ ID NO: 3466 - DNA, 25 bp, Homo sapiens
ccctggacagcaggaaacctgtata

SEQ ID NO: 3467 - DNA, 25 bp, Homo sapiens
ctggacagcaggaaacctgtatatt

SEQ ID NO: 3468 - DNA, 25 bp, Homo sapiens
attagatagtgcatcttctgaggtc

SEQ ID NO: 3469 - DNA, 25 bp, Homo sapiens
ttagatagtgcatcttctgaggtca

SEQ ID NO: 3470 - DNA, 25 bp, Homo sapiens
tagatagtgcatcttctgaggtcaa

SEQ ID NO: 3471 - DNA, 25 bp, Homo sapiens
agatagtgcatcttctgaggtcaat

SEQ ID NO: 3472 - DNA, 25 bp, Homo sapiens
atagtgcatcttctgaggtcaatta

SEQ ID NO: 3473 - DNA, 25 bp, Homo sapiens
agtgcatcttctgaggtcaattaaa

SEQ ID NO: 3474 - DNA, 25 bp, Homo sapiens
gtgcatcttctgaggtcaattaaaa

SEQ ID NO: 3475 - DNA, 25 bp, Homo sapiens
gcatcttctgaggtcaattaaaagg

SEQ ID NO: 3476 - DNA, 25 bp, Homo sapiens
catcttctgaggtcaattaaaagga

SEQ ID NO: 3477 - DNA, 25 bp, Homo sapiens
ttagtttgtggcttcatggaaactc

SEQ ID NO: 3478 - DNA, 25 bp, Homo sapiens
tagtttgtggcttcatggaaactcc

SEQ ID NO: 3479 - DNA, 25 bp, Homo sapiens
gtggcttcatggaaactccctgtaa

SEQ ID NO: 3480 - DNA, 25 bp, Homo sapiens
ggcttcatggaaactccctgtaaac

SEQ ID NO: 3481 - DNA, 25 bp, Homo sapiens
gcttcatggaaactccctgtaaact

SEQ ID NO: 3482 - DNA, 25 bp, Homo sapiens
ctccctgtaaactaaaagcttcagg

SEQ ID NO: 3483 - DNA, 25 bp, Homo sapiens
aactaaaagcttcagggttatgtct

SEQ ID NO: 3484 - DNA, 25 bp, Homo sapiens
ctttcctgttgtctacaccaatgcc

SEQ ID NO: 3485 - DNA, 25 bp, Homo sapiens
cctgccttagggtagtgctaagagg

SEQ ID NO: 3486 - DNA, 25 bp, Homo sapiens
gaggatctcctgtccatcagccagg

SEQ ID NO: 3487 - DNA, 25 bp, Homo sapiens
tccatcagccaggacagtcagctct

SEQ ID NO: 3488 - DNA, 25 bp, Homo sapiens
ttttgttgagccaggcctctctcac

SEQ ID NO: 3489 - DNA, 25 bp, Homo sapiens
ttaaagcccgcctgacagaaaccac

SEQ ID NO: 3490 - DNA, 25 bp, Homo sapiens
gaaaccacggccacatttggttcta

SEQ ID NO: 3491 - DNA, 25 bp, Homo sapiens
taagaaaccctctgtcattcgctcc

SEQ ID NO: 3492 - DNA, 25 bp, Homo sapiens
acattctgatgagcaaccgcttccc

SEQ ID NO: 3493 - DNA, 25 bp, Homo sapiens
aatttggactggtgtgctctcttta

SEQ ID NO: 3494 - DNA, 25 bp, Homo sapiens
caaatatcatactgttcaatggttc

SEQ ID NO: 3495 - DNA, 25 bp, Homo sapiens
acttcaccatgcaatttgtgtcttc

SEQ ID NO: 3496 - DNA, 25 bp, Homo sapiens
atttgtgtcttcctaaagagagctg

SEQ ID NO: 3497 - DNA, 25 bp, Homo sapiens
tgtacccagagagtcctgtgctgaa

SEQ ID NO: 3498 - DNA, 25 bp, Homo sapiens
gactcaatccctagggctggcagaa

SEQ ID NO: 3499 - DNA, 25 bp, Homo sapiens
gctatagcctggactttcctgttgt

SEQ ID NO: 3500 - DNA, 25 bp, Homo sapiens
gggtctgcgcttggtctttctgtgc

SEQ ID NO: 3501 - DNA, 25 bp, Homo sapiens
tggtctttctgtgcttggatttgca

SEQ ID NO: 3502 - DNA, 25 bp, Homo sapiens
tattgcattgctggtagagaccccc

SEQ ID NO: 3503 - DNA, 25 bp, Homo sapiens
cattgctggtagagacccccaggcc

SEQ ID NO: 3504 - DNA, 25 bp, Homo sapiens
ctgccaagactcctcaggcagcgtg

SEQ ID NO: 3505 - DNA, 25 bp, Homo sapiens
aggcattggctcagcccgctgagtg

SEQ ID NO: 3506 - DNA, 25 bp, Homo sapiens
tgggcccctgcacaggcacacaggg

SEQ ID NO: 3507 - DNA, 25 bp, Homo sapiens
ccgggcaccaactccatgtttggtg

SEQ ID NO: 3508 - DNA, 25 bp, Homo sapiens
caccaactccatgtttggtgtttgt

SEQ ID NO: 3509 - DNA, 25 bp, Homo sapiens
actccatgtttggtgtttgtctgtg

SEQ ID NO: 3510 - DNA, 25 bp, Homo sapiens
aatttactgtaactgtcagtgtaca

SEQ ID NO: 3511 - DNA, 25 bp, Homo sapiens
atttactgtaactgtcagtgtacac

SEQ ID NO: 3512 - DNA, 25 bp, Homo sapiens
taactgtcagtgtacacgtctggac

SEQ ID NO: 3513 - DNA, 25 bp, Homo sapiens
gtcagtgtacacgtctggaccccgt

SEQ ID NO: 3514 - DNA, 25 bp, Homo sapiens
gtgtacacgtctggaccccgtttca

SEQ ID NO: 3515 - DNA, 25 bp, Homo sapiens
gtacacgtctggaccccgtttcatt

SEQ ID NO: 3516 - DNA, 25 bp, Homo sapiens
ttcatgtgtgtgagtttgctggttg

SEQ ID NO: 3517 - DNA, 25 bp, Homo sapiens
gtgtgtgagtttgctggttgtaaat

SEQ ID NO: 3518 - DNA, 25 bp, Homo sapiens
gagtttgctggttgtaaatactttg

SEQ ID NO: 3519 - DNA, 25 bp, Homo sapiens
aatactttgtcctaagagatttatc

SEQ ID NO: 3520 - DNA, 25 bp, Homo sapiens
tactttgtcctaagagatttatctt

SEQ ID NO: 3521 - DNA, 25 bp, Homo sapiens
ttgtcctaagagatttatctttata

SEQ ID NO: 3522 - DNA, 25 bp, Homo sapiens
tatctttatacagattttctagaaa

SEQ ID NO: 3523 - DNA, 25 bp, Homo sapiens
tctttatacagattttctagaaatg

SEQ ID NO: 3524 - DNA, 25 bp, Homo sapiens
ttatacagattttctagaaatgttt

SEQ ID NO: 3525 - DNA, 25 bp, Homo sapiens
tgggcaaactctctaaactggtaca

SEQ ID NO: 3526 - DNA, 25 bp, Homo sapiens
ggcaaactctctaaactggtacaat

SEQ ID NO: 3527 - DNA, 25 bp, Homo sapiens
actctctaaactggtacaattttat

SEQ ID NO: 3528 - DNA, 25 bp, Homo sapiens
tgcctcagagggtagccttgatttg

SEQ ID NO: 3529 - DNA, 25 bp, Homo sapiens
cctcagagggtagccttgatttgtt

SEQ ID NO: 3530 - DNA, 25 bp, Homo sapiens
cagagggtagccttgatttgttctt

SEQ ID NO: 3531 - DNA, 25 bp, Homo sapiens
gagggtagccttgatttgttcttac

SEQ ID NO: 3532 - DNA, 25 bp, Homo sapiens
ttctttctagagagggaattctctt

SEQ ID NO: 3533 - DNA, 25 bp, Homo sapiens
actgtgtccctctctctggaaagga

SEQ ID NO: 3534 - DNA, 25 bp, Homo sapiens
ggagcctatggcatcttccccaacg

SEQ ID NO: 3535 - DNA, 25 bp, Homo sapiens
cccaacgaaaagcacatccaggcaa

SEQ ID NO: 3536 - DNA, 25 bp, Homo sapiens
cacatccaggcaatggcctaaactt

SEQ ID NO: 3537 - DNA, 25 bp, Homo sapiens
ggcaatggcctaaacttcagagggg

SEQ ID NO: 3538 - DNA, 25 bp, Homo sapiens
cagcatcctcagttcctgcagcaga

SEQ ID NO: 3539 - DNA, 25 bp, Homo sapiens
agttcctgcagcagagcctggaaga

SEQ ID NO: 3540 - DNA, 25 bp, Homo sapiens
tgcagcagagcctggaagacaccct

SEQ ID NO: 3541 - DNA, 25 bp, Homo sapiens
agagcctggaagacaccctaatgtg

SEQ ID NO: 3542 - DNA, 25 bp, Homo sapiens
tggaagacaccctaatgtggcagct

SEQ ID NO: 3543 - DNA, 25 bp, Homo sapiens
ggcagctgtctcaaacctccaaaag

SEQ ID NO: 3544 - DNA, 25 bp, Homo sapiens
aagtatccttgttgacacggccatg

SEQ ID NO: 3545 - DNA, 25 bp, Homo sapiens
tttacacaaacctgaaaagatgttg

SEQ ID NO: 3546 - DNA, 25 bp, Homo sapiens
tcagcctcaaatgcagtatttttgt

SEQ ID NO: 3547 - DNA, 25 bp, Homo sapiens
gtgtttaacggcactgtggccttgg

SEQ ID NO: 3548 - DNA, 25 bp, Homo sapiens
tgcaaccttaattcagctgaagtac

SEQ ID NO: 3549 - DNA, 25 bp, Homo sapiens
gcaaccttaattcagctgaagtact

SEQ ID NO: 3550 - DNA, 25 bp, Homo sapiens
tgtggccttatatatcacactattg

SEQ ID NO: 3551 - DNA, 25 bp, Homo sapiens
ggccttatatatcacactattgtag

SEQ ID NO: 3552 - DNA, 25 bp, Homo sapiens
tcaacagaaaccaagatagagctac

SEQ ID NO: 3553 - DNA, 25 bp, Homo sapiens
agatagagctacaaactcagctgta

SEQ ID NO: 3554 - DNA, 25 bp, Homo sapiens
agctacaaactcagctgtacagttc

SEQ ID NO: 3555 - DNA, 25 bp, Homo sapiens
ctcttcttgcttttgcattataagg

SEQ ID NO: 3556 - DNA, 25 bp, Homo sapiens
cttcttgcttttgcattataaggaa

SEQ ID NO: 3557 - DNA, 25 bp, Homo sapiens
ttaagtctccgattattaggtgatc

SEQ ID NO: 3558 - DNA, 25 bp, Homo sapiens
tattaggtgatcaccctggatgatc

SEQ ID NO: 3559 - DNA, 25 bp, Homo sapiens
tcctctttatcactctgcattggtg

SEQ ID NO: 3560 - DNA, 25 bp, Homo sapiens
actctgcattggtgaatttaatcct

SEQ ID NO: 3561 - DNA, 25 bp, Homo sapiens
ggtgaatttaatcctctcctttgtg

SEQ ID NO: 3562 - DNA, 25 bp, Homo sapiens
gtgaatttaatcctctcctttgtgt

SEQ ID NO: 3563 - DNA, 25 bp, Homo sapiens
cagctttattctaagcaaatctgtg

SEQ ID NO: 3564 - DNA, 25 bp, Homo sapiens
tgccatcttaggttgccatgagcca

SEQ ID NO: 3565 - DNA, 25 bp, Homo sapiens
ctttagttcaatggacagacctccc

SEQ ID NO: 3566 - DNA, 25 bp, Homo sapiens
tagttcaatggacagacctcccaag

SEQ ID NO: 3567 - DNA, 25 bp, Homo sapiens
aggcaaaaactaccttctgacttgg

SEQ ID NO: 3568 - DNA, 25 bp, Homo sapiens
attgttcccctatcataagagctag

SEQ ID NO: 3569 - DNA, 25 bp, Homo sapiens
atcataagagctaggccaagcctat

SEQ ID NO: 3570 - DNA, 25 bp, Homo sapiens
caagcctatgggaccttgagtcatg

SEQ ID NO: 3571 - DNA, 25 bp, Homo sapiens
cttgagtcatgcaggatgggatctg

SEQ ID NO: 3572 - DNA, 25 bp, Homo sapiens
tcttccccatcttgcattggaggtc

SEQ ID NO: 3573 - DNA, 25 bp, Homo sapiens
ttgcattggaggtcccagaaaacaa

SEQ ID NO: 3574 - DNA, 25 bp, Homo sapiens
cagaaaacaattagcttctggcaaa

SEQ ID NO: 3575 - DNA, 25 bp, Homo sapiens
ttgctgtttcccaggctcctttttg

SEQ ID NO: 3576 - DNA, 25 bp, Homo sapiens
tatatattgttctgaggcgcctggc

SEQ ID NO: 3577 - DNA, 25 bp, Homo sapiens
aggcgcctggcctgtcccttcagtg

SEQ ID NO: 3578 - DNA, 25 bp, Homo sapiens
gcgcctggcctgtcccttcagtgag

SEQ ID NO: 3579 - DNA, 25 bp, Homo sapiens
agtgagaagctgttgtcacgactaa

SEQ ID NO: 3580 - DNA, 25 bp, Homo sapiens
ccgcaaggtgcagcacgagctggat

SEQ ID NO: 3581 - DNA, 25 bp, Homo sapiens
cgtgacattggcacgaagggcttga

SEQ ID NO: 3582 - DNA, 25 bp, Homo sapiens
gtgacattggcacgaagggcttgaa

SEQ ID NO: 3583 - DNA, 25 bp, Homo sapiens
tgacattggcacgaagggcttgaat

SEQ ID NO: 3584 - DNA, 25 bp, Homo sapiens
gacattggcacgaagggcttgaatg

SEQ ID NO: 3585 - DNA, 25 bp, Homo sapiens
acattggcacgaagggcttgaatga

SEQ ID NO: 3586 - DNA, 25 bp, Homo sapiens
tgaggagtagctttgccacatcttg

SEQ ID NO: 3587 - DNA, 25 bp, Homo sapiens
agtagctttgccacatcttgatctg

SEQ ID NO: 3588 - DNA, 25 bp, Homo sapiens
tagctttgccacatcttgatctgct

SEQ ID NO: 3589 - DNA, 25 bp, Homo sapiens
gctttgccacatcttgatctgctca

SEQ ID NO: 3590 - DNA, 25 bp, Homo sapiens
tttgccacatcttgatctgctcagc

SEQ ID NO: 3591 - DNA, 25 bp, Homo sapiens
ttgccacatcttgatctgctcagcc

SEQ ID NO: 3592 - DNA, 25 bp, Homo sapiens
cttgatctgctcagccctggaggtg

SEQ ID NO: 3593 - DNA, 25 bp, Homo sapiens
tctgctcagccctggaggtgccagc

SEQ ID NO: 3594 - DNA, 25 bp, Homo sapiens
cagccctggaggtgccagcaaagcc

SEQ ID NO: 3595 - DNA, 25 bp, Homo sapiens
cctggaggtgccagcaaagccccat

SEQ ID NO: 3596 - DNA, 25 bp, Homo sapiens
acggctatagcctggactttcctgt

SEQ ID NO: 3597 - DNA, 25 bp, Homo sapiens
actgcctgccttagggtagtgctaa

SEQ ID NO: 3598 - DNA, 25 bp, Homo sapiens
aggacagtcagctctctcctttcag

SEQ ID NO: 3599 - DNA, 25 bp, Homo sapiens
ggacagtcagctctctcctttcagg

SEQ ID NO: 3600 - DNA, 25 bp, Homo sapiens
gtcagctctctcctttcagggccaa

SEQ ID NO: 3601 - DNA, 25 bp, Homo sapiens
ttttgttgagccaggcctctctcac

SEQ ID NO: 3602 - DNA, 25 bp, Homo sapiens
ttaaagcccgcctgacagaaaccac

SEQ ID NO: 3603 - DNA, 25 bp, Homo sapiens
ctgacagaaaccacggccacatttg

SEQ ID NO: 3604 - DNA, 25 bp, Homo sapiens
cacggccacatttggttctaagaaa

SEQ ID NO: 3605 - DNA, 25 bp, Homo sapiens
agtagcagtgtctgtaaaagagcct

SEQ ID NO: 3606 - DNA, 25 bp, Homo sapiens
gtagcagtgtctgtaaaagagccta

SEQ ID NO: 3607 - DNA, 25 bp, Homo sapiens
atcaattcaatttggactggtgtgc

SEQ ID NO: 3608 - DNA, 25 bp, Homo sapiens
gtgtgctctctttaaatcaagtcct

SEQ ID NO: 3609 - DNA, 25 bp, Homo sapiens
tgagcaaatatcatactgttcaatg

SEQ ID NO: 3610 - DNA, 25 bp, Homo sapiens
aatgtggactcaatccctagggctg

SEQ ID NO: 3611 - DNA, 25 bp, Homo sapiens
aatccctagggctggcagaaaggga

SEQ ID NO: 3612 - DNA, 25 bp, Homo sapiens
gtggctcctgttgtcttgcgctctg

SEQ ID NO: 3613 - DNA, 25 bp, Homo sapiens
cgctctgggaagtcagatgtcattt

SEQ ID NO: 3614 - DNA, 25 bp, Homo sapiens
tcagatgtcatttcaggcctgcagt

SEQ ID NO: 3615 - DNA, 25 bp, Homo sapiens
atcctcccatcgatgtgccacgtgg

SEQ ID NO: 3616 - DNA, 25 bp, Homo sapiens
cacgtgggtgtcacgtgtcccagat

SEQ ID NO: 3617 - DNA, 25 bp, Homo sapiens
cccagatgcagtattcggcagccag

SEQ ID NO: 3618 - DNA, 25 bp, Homo sapiens
ccaccttggggcttctcatgggaaa

SEQ ID NO: 3619 - DNA, 25 bp, Homo sapiens
accttggggcttctcatgggaaatg

SEQ ID NO: 3620 - DNA, 25 bp, Homo sapiens
gcttctcatgggaaatgtgcccccg

SEQ ID NO: 3621 - DNA, 25 bp, Homo sapiens
tcggctttactcctgcccagtgact

SEQ ID NO: 3622 - DNA, 25 bp, Homo sapiens
cggctttactcctgcccagtgactg

SEQ ID NO: 3623 - DNA, 25 bp, Homo sapiens
ttactcctgcccagtgactgtgacc

SEQ ID NO: 3624 - DNA, 25 bp, Homo sapiens
actgtgaccactgtccgtgttgcct

SEQ ID NO: 3625 - DNA, 25 bp, Homo sapiens
ttcaccaaaggtcttggtacaacca

SEQ ID NO: 3626 - DNA, 25 bp, Homo sapiens
tcttggtacaaccagctgcccattt

SEQ ID NO: 3627 - DNA, 25 bp, Homo sapiens
accagctgcccattttgtgaaattt

SEQ ID NO: 3628 - DNA, 25 bp, Homo sapiens
caagcccagggcatagatgctgaga

SEQ ID NO: 3629 - DNA, 25 bp, Homo sapiens
tctccctctcagtgcagggacgtca

SEQ ID NO: 3630 - DNA, 25 bp, Homo sapiens
ctctccctctcagtgtgaggcttca

SEQ ID NO: 3631 - DNA, 25 bp, Homo sapiens
tctcagtgcgggaacgtcacccctg

SEQ ID NO: 3632 - DNA, 25 bp, Homo sapiens
gggcacagatgctgcgatggcctct

SEQ ID NO: 3633 - DNA, 25 bp, Homo sapiens
tgcgatggcctcttcctcttaagtg

SEQ ID NO: 3634 - DNA, 25 bp, Homo sapiens
atggcctcttcctcttaagtgtggg

SEQ ID NO: 3635 - DNA, 25 bp, Homo sapiens
aattgtatttccatattgaagcagc

SEQ ID NO: 3636 - DNA, 25 bp, Homo sapiens
attgtatttccatattgaagcagct

SEQ ID NO: 3637 - DNA, 25 bp, Homo sapiens
gtatttccatattgaagcagcttga

SEQ ID NO: 3638 - DNA, 25 bp, Homo sapiens
ccatattgaagcagcttgagtttct

SEQ ID NO: 3639 - DNA, 25 bp, Homo sapiens
tattgaagcagcttgagtttctact

SEQ ID NO: 3640 - DNA, 25 bp, Homo sapiens
tgaagcagcttgagtttctactgaa

SEQ ID NO: 3641 - DNA, 25 bp, Homo sapiens
ctggcattctgagaattagactgaa

SEQ ID NO: 3642 - DNA, 25 bp, Homo sapiens
aaattgaggctccacggaggcccgt

SEQ ID NO: 3643 - DNA, 25 bp, Homo sapiens
gcatttcgcttttcagtaaaaacag

SEQ ID NO: 3644 - DNA, 25 bp, Homo sapiens
tagccacatctcagcaaggaaacta

SEQ ID NO: 3645 - DNA, 25 bp, Homo sapiens
agccacatctcagcaaggaaactag

SEQ ID NO: 3646 - DNA, 25 bp, Homo sapiens
ggaaaatctgtatccttgctggaaa

SEQ ID NO: 3647 - DNA, 25 bp, Homo sapiens
aaatctgtatccttgctggaaacca

SEQ ID NO: 3648 - DNA, 25 bp, Homo sapiens
tgtatccttgctggaaaccagggca

SEQ ID NO: 3649 - DNA, 25 bp, Homo sapiens
gtatccttgctggaaaccagggcag

SEQ ID NO: 3650 - DNA, 25 bp, Homo sapiens
atccttgctggaaaccagggcagtg

SEQ ID NO: 3651 - DNA, 25 bp, Homo sapiens
ccttgctggaaaccagggcagtgca

SEQ ID NO: 3652 - DNA, 25 bp, Homo sapiens
cttgctggaaaccagggcagtgcac

SEQ ID NO: 3653 - DNA, 25 bp, Homo sapiens
ggaaaccagggcagtgcacatataa

SEQ ID NO: 3654 - DNA, 25 bp, Homo sapiens
aaccagggcagtgcacatataagag

SEQ ID NO: 3655 - DNA, 25 bp, Homo sapiens
ccagggcagtgcacatataagagta

SEQ ID NO: 3656 - DNA, 25 bp, Homo sapiens
ggaagaccatgtagcagctgtgtga

SEQ ID NO: 3657 - DNA, 25 bp, Homo sapiens
gaagaccatgtagcagctgtgtgag

SEQ ID NO: 3658 - DNA, 25 bp, Homo sapiens
aagaccatgtagcagctgtgtgaga

SEQ ID NO: 3659 - DNA, 25 bp, Homo sapiens
agaccatgtagcagctgtgtgagag

SEQ ID NO: 3660 - DNA, 25 bp, Homo sapiens
taaggcttttagtcccaccgacatt

SEQ ID NO: 3661 - DNA, 25 bp, Homo sapiens
ccgacattagccaggctcgtagtga

SEQ ID NO: 3662 - DNA, 25 bp, Homo sapiens
cagagcaggttgtgctgtcccctgc

SEQ ID NO: 3663 - DNA, 25 bp, Homo sapiens
ccctgcctctggaagcaatggggaa

SEQ ID NO: 3664 - DNA, 25 bp, Homo sapiens
cctctggaagcaatggggaatttgg

SEQ ID NO: 3665 - DNA, 25 bp, Homo sapiens
aatttggaatcttgtgtaagtgccc

SEQ ID NO: 3666 - DNA, 25 bp, Homo sapiens
tttggaatcttgtgtaagtgcccaa

SEQ ID NO: 3667 - DNA, 25 bp, Homo sapiens
gtgtaagtgcccaaataagtctgag

SEQ ID NO: 3668 - DNA, 25 bp, Homo sapiens
caaataagtctgagtgctttcctct

SEQ ID NO: 3669 - DNA, 25 bp, Homo sapiens
caatcccttagcactgattgattag

SEQ ID NO: 3670 - DNA, 25 bp, Homo sapiens
agcactgattgattagagaggtccc

SEQ ID NO: 3671 - DNA, 25 bp, Homo sapiens
tcattggatgggtcataatgttcca

SEQ ID NO: 3672 - DNA, 25 bp, Homo sapiens
ggtcataatgttccatgaaacctct

SEQ ID NO: 3673 - DNA, 25 bp, Homo sapiens
caagtacacaattgtatgttctttg

SEQ ID NO: 3674 - DNA, 25 bp, Homo sapiens
cttttgcagcttcctataaagtttg

SEQ ID NO: 3675 - DNA, 25 bp, Homo sapiens
gcagcttcctataaagtttgtcttc

SEQ ID NO: 3676 - DNA, 25 bp, Homo sapiens
ggtgtcaagtcctctggtggcagtt

SEQ ID NO: 3677 - DNA, 25 bp, Homo sapiens
tctggtggcagttccagcgtgaggt

SEQ ID NO: 3678 - DNA, 25 bp, Homo sapiens
agagatgccctctgtttcattagct

SEQ ID NO: 3679 - DNA, 25 bp, Homo sapiens
tgtttcattagctctagttctcccc

SEQ ID NO: 3680 - DNA, 25 bp, Homo sapiens
tcactaacaaatatgcttggcaaga

SEQ ID NO: 3681 - DNA, 25 bp, Homo sapiens
atgcttggcaagaccgaggtcgatt

SEQ ID NO: 3682 - DNA, 25 bp, Homo sapiens
tggttagttacactagctcatccta

SEQ ID NO: 3683 - DNA, 25 bp, Homo sapiens
gttacactagctcatcctattcccc

SEQ ID NO: 3684 - DNA, 25 bp, Homo sapiens
gaagttttcagatcagtggcaatct

SEQ ID NO: 3685 - DNA, 25 bp, Homo sapiens
tcagttcccttgctatgaccctgct

SEQ ID NO: 3686 - DNA, 25 bp, Homo sapiens
cgagaaacagttcagcagtgaccac

SEQ ID NO: 3687 - DNA, 25 bp, Homo sapiens
acatgacatttcaagcaccacctta

SEQ ID NO: 3688 - DNA, 25 bp, Homo sapiens
catttcaagcaccaccttaagccag

SEQ ID NO: 3689 - DNA, 25 bp, Homo sapiens
aagccagccagagtaggaccagtta

SEQ ID NO: 3690 - DNA, 25 bp, Homo sapiens
tggacagctccttgcatcttaacac

SEQ ID NO: 3691 - DNA, 25 bp, Homo sapiens
gctccttgcatcttaacactgtgct

SEQ ID NO: 3692 - DNA, 25 bp, Homo sapiens
gccacttatggatttccacacagca

SEQ ID NO: 3693 - DNA, 25 bp, Homo sapiens
tcccagctccacattaagacacagg

SEQ ID NO: 3694 - DNA, 25 bp, Homo sapiens
cattaagacacaggatcttaaaagt

SEQ ID NO: 3695 - DNA, 25 bp, Homo sapiens
tacatatcacctttgttgaagctag

SEQ ID NO: 3696 - DNA, 25 bp, Homo sapiens
cctttgttgaagctagcaaaatggc

SEQ ID NO: 3697 - DNA, 25 bp, Homo sapiens
acgatagtcataccacaaaagatag

SEQ ID NO: 3698 - DNA, 25 bp, Homo sapiens
taccacaaaagatagcatagctagg

SEQ ID NO: 3699 - DNA, 25 bp, Homo sapiens
gggcctacctggtcgtatcaacaca

SEQ ID NO: 3700 - DNA, 25 bp, Homo sapiens
agcttgttactggaatcttatgtgc

SEQ ID NO: 3701 - DNA, 25 bp, Homo sapiens
tactggaatcttatgtgcattacag

SEQ ID NO: 3702 - DNA, 25 bp, Homo sapiens
ggatcaatccggttgcatccttcaa

SEQ ID NO: 3703 - DNA, 25 bp, Homo sapiens
gatcaatccggttgcatccttcaat

SEQ ID NO: 3704 - DNA, 25 bp, Homo sapiens
cttttggttttcattacagtaggct

SEQ ID NO: 3705 - DNA, 25 bp, Homo sapiens
tttcattacagtaggctatgttagc

SEQ ID NO: 3706 - DNA, 25 bp, Homo sapiens
cagtaggctatgttagcctttattt

SEQ ID NO: 3707 - DNA, 25 bp, Homo sapiens
ttattttggtggttctcaaatacct

SEQ ID NO: 3708 - DNA, 25 bp, Homo sapiens
atatagacctatgatgtacaggtac

SEQ ID NO: 3709 - DNA, 25 bp, Homo sapiens
acctatgatgtacaggtacgacatg

SEQ ID NO: 3710 - DNA, 25 bp, Homo sapiens
caggtacgacatgtataggttacct

SEQ ID NO: 3711 - DNA, 25 bp, Homo sapiens
tttttgattaagcaatgcagcctag

SEQ ID NO: 3712 - DNA, 25 bp, Homo sapiens
tgattaagcaatgcagcctagaagc

SEQ ID NO: 3713 - DNA, 25 bp, Homo sapiens
attaagcaatgcagcctagaagcaa

SEQ ID NO: 3714 - DNA, 25 bp, Homo sapiens
caatgcagcctagaagcaatggttc

SEQ ID NO: 3715 - DNA, 25 bp, Homo sapiens
ctgttcaatcattcagatgttagtg

SEQ ID NO: 3716 - DNA, 25 bp, Homo sapiens
agactgcatgttgaaacctttcttt

SEQ ID NO: 3717 - DNA, 25 bp, Homo sapiens
actttggtggcctgcttccctcatg

SEQ ID NO: 3718 - DNA, 25 bp, Homo sapiens
ctttggtggcctgcttccctcatgc

SEQ ID NO: 3719 - DNA, 25 bp, Homo sapiens
tttggtggcctgcttccctcatgcc

SEQ ID NO: 3720 - DNA, 25 bp, Homo sapiens
cctcatgccctggaatacaactcag

SEQ ID NO: 3721 - DNA, 25 bp, Homo sapiens
gaatacaactcagagctccaggcag

SEQ ID NO: 3722 - DNA, 25 bp, Homo sapiens
caggcagcggaaccatctattgttt

SEQ ID NO: 3723 - DNA, 25 bp, Homo sapiens
tgcatgtgcaggactattcgagtat

SEQ ID NO: 3724 - DNA, 25 bp, Homo sapiens
ttggccctcaactggggcaagtgaa

SEQ ID NO: 3725 - DNA, 25 bp, Homo sapiens
ctcaactggggcaagtgaagccaga

SEQ ID NO: 3726 - DNA, 25 bp, Homo sapiens
caactggggcaagtgaagccagagg

SEQ ID NO: 3727 - DNA, 25 bp, Homo sapiens
ctgctccttccggacaatgaagaag

SEQ ID NO: 3728 - DNA, 25 bp, Homo sapiens
ctccttccggacaatgaagaagcct

SEQ ID NO: 3729 - DNA, 25 bp, Homo sapiens
cttccggacaatgaagaagcctttg

SEQ ID NO: 3730 - DNA, 25 bp, Homo sapiens
atgaagaagcctttgcaccctggga

SEQ ID NO: 3731 - DNA, 25 bp, Homo sapiens
agaagcctttgcaccctgggaggaa

SEQ ID NO: 3732 - DNA, 25 bp, Homo sapiens
tttgcaccctgggaggaaggaccac

SEQ ID NO: 3733 - DNA, 25 bp, Homo sapiens
ggtttggaagcttctggaagtcgtg

SEQ ID NO: 3734 - DNA, 25 bp, Homo sapiens
ttggaagcttctggaagtcgtgctg

SEQ ID NO: 3735 - DNA, 25 bp, Homo sapiens
ggaagcttctggaagtcgtgctggt

SEQ ID NO: 3736 - DNA, 25 bp, Homo sapiens
agcttctggaagtcgtgctggtctc

SEQ ID NO: 3737 - DNA, 25 bp, Homo sapiens
ttctggaagtcgtgctggtctccca

SEQ ID NO: 3738 - DNA, 25 bp, Homo sapiens
ctggaagtcgtgctggtctcccagg

SEQ ID NO: 3739 - DNA, 25 bp, Homo sapiens
gaagtcgtgctggtctcccaggtga

SEQ ID NO: 3740 - DNA, 25 bp, Homo sapiens
ggtttacacgctaatcccgattcac

SEQ ID NO: 3741 - DNA, 25 bp, Homo sapiens
attctcaagccctgcagtcacagct

SEQ ID NO: 3742 - DNA, 25 bp, Homo sapiens
ttctcaagccctgcagtcacagcta

SEQ ID NO: 3743 - DNA, 25 bp, Homo sapiens
gatcacagcttcagccaggagctgg

SEQ ID NO: 3744 - DNA, 25 bp, Homo sapiens
agcttcagccaggagctgggcagaa

SEQ ID NO: 3745 - DNA, 25 bp, Homo sapiens
aggccaagaggctgttcccaccagg

SEQ ID NO: 3746 - DNA, 25 bp, Homo sapiens
gccaagaggctgttcccaccaggct

SEQ ID NO: 3747 - DNA, 25 bp, Homo sapiens
accaggctgctcagggctggtcttt

SEQ ID NO: 3748 - DNA, 25 bp, Homo sapiens
gctgctcagggctggtcttttagga

SEQ ID NO: 3749 - DNA, 25 bp, Homo sapiens
tcagggctggtcttttaggaccctt

SEQ ID NO: 3750 - DNA, 25 bp, Homo sapiens
tcccttgagccctctatggtgtggc

SEQ ID NO: 3751 - DNA, 25 bp, Homo sapiens
ctatggtgtggcaaagccttcattg

SEQ ID NO: 3752 - DNA, 25 bp, Homo sapiens
tgtggcaaagccttcattgccttaa

SEQ ID NO: 3753 - DNA, 25 bp, Homo sapiens
tgccttaactggagccccatcagct

SEQ ID NO: 3754 - DNA, 25 bp, Homo sapiens
atcagctccagctgctctgtcttct

SEQ ID NO: 3755 - DNA, 25 bp, Homo sapiens
ctgtcctgacctgtctcaccatgta

SEQ ID NO: 3756 - DNA, 25 bp, Homo sapiens
gctacttcattgacgctgccacagt

SEQ ID NO: 3757 - DNA, 25 bp, Homo sapiens
tggagagtacaggtgccagacaaac

SEQ ID NO: 3758 - DNA, 25 bp, Homo sapiens
tacaggtgccagacaaacctctcca

SEQ ID NO: 3759 - DNA, 25 bp, Homo sapiens
tcagtgacccggtgcagctagaagt

SEQ ID NO: 3760 - DNA, 25 bp, Homo sapiens
gaggaagaccctattcacctgaggt

SEQ ID NO: 3761 - DNA, 25 bp, Homo sapiens
ggtcacatatttacagaatggcaaa

SEQ ID NO: 3762 - DNA, 25 bp, Homo sapiens
aaatgtgtcttcagagactgtgaac

SEQ ID NO: 3763 - DNA, 25 bp, Homo sapiens
ggcagtgtcaaccatctcatcattc

SEQ ID NO: 3764 - DNA, 25 bp, Homo sapiens
caagtctctttctgcttggtgatgg

SEQ ID NO: 3765 - DNA, 25 bp, Homo sapiens
tggtactcctttttgcagtggacac

SEQ ID NO: 3766 - DNA, 25 bp, Homo sapiens
acacaggactatatttctctgtgaa

SEQ ID NO: 3767 - DNA, 25 bp, Homo sapiens
gacaaacatttgaagctcaacaaga

SEQ ID NO: 3768 - DNA, 25 bp, Homo sapiens
ctcaacaagagactggaaggaccat

SEQ ID NO: 3769 - DNA, 25 bp, Homo sapiens
gagaaaggaccctcaagacaaatga

SEQ ID NO: 3770 - DNA, 25 bp, Homo sapiens
gaaaggaccctcaagacaaatgacc

SEQ ID NO: 3771 - DNA, 25 bp, Homo sapiens
gcagcagcatctctgaacatttctc

SEQ ID NO: 3772 - DNA, 25 bp, Homo sapiens
ggttgaatgtttgtccttaggatag

SEQ ID NO: 3773 - DNA, 25 bp, Homo sapiens
atgtttgtccttaggataggcctat

SEQ ID NO: 3774 - DNA, 25 bp, Homo sapiens
aggataggcctatgtgctagcccac

SEQ ID NO: 3775 - DNA, 25 bp, Homo sapiens
tgtgctagcccacaaagaatattgt

SEQ ID NO: 3776 - DNA, 25 bp, Homo sapiens
agcccacaaagaatattgtctcatt

SEQ ID NO: 3777 - DNA, 25 bp, Homo sapiens
atattgtctcattagcctgaatgtg

SEQ ID NO: 3778 - DNA, 25 bp, Homo sapiens
tctcattagcctgaatgtgccataa

SEQ ID NO: 3779 - DNA, 25 bp, Homo sapiens
gttttgagggatctgtggatgcttc

SEQ ID NO: 3780 - DNA, 25 bp, Homo sapiens
atgcttcgttaatttgttcagccac

SEQ ID NO: 3781 - DNA, 25 bp, Homo sapiens
cgttaatttgttcagccacaattta

SEQ ID NO: 3782 - DNA, 25 bp, Homo sapiens
tttgttcagccacaatttattgaga

SEQ ID NO: 3783 - DNA, 25 bp, Homo sapiens
cagccacaatttattgagaaaatat

SEQ ID NO: 3784 - DNA, 25 bp, Homo sapiens
ttctgtgtcaagcactgtgggtttt

SEQ ID NO: 3785 - DNA, 25 bp, Homo sapiens
ttttaaatcaaacgctgattacaga

SEQ ID NO: 3786 - DNA, 25 bp, Homo sapiens
tatcattaaagataactcaggagaa

SEQ ID NO: 3787 - DNA, 25 bp, Homo sapiens
taactcaggagaatcttctttacaa

SEQ ID NO: 3788 - DNA, 25 bp, Homo sapiens
aattatactacttctaaggtagctg

SEQ ID NO: 3789 - DNA, 25 bp, Homo sapiens
ttatactacttctaaggtagctgca

SEQ ID NO: 3790 - DNA, 25 bp, Homo sapiens
atactacttctaaggtagctgcaga

SEQ ID NO: 3791 - DNA, 25 bp, Homo sapiens
actacttctaaggtagctgcagata

SEQ ID NO: 3792 - DNA, 25 bp, Homo sapiens
tacttctaaggtagctgcagataag

SEQ ID NO: 3793 - DNA, 25 bp, Homo sapiens
cttctaaggtagctgcagataagtg

SEQ ID NO: 3794 - DNA, 25 bp, Homo sapiens
tctaaggtagctgcagataagtggc

SEQ ID NO: 3795 - DNA, 25 bp, Homo sapiens
ctaaggtagctgcagataagtggcc

SEQ ID NO: 3796 - DNA, 25 bp, Homo sapiens
aaggtagctgcagataagtggcctt

SEQ ID NO: 3797 - DNA, 25 bp, Homo sapiens
aggtagctgcagataagtggccttg

SEQ ID NO: 3798 - DNA, 25 bp, Homo sapiens
tagctgcagataagtggccttgaca

SEQ ID NO: 3799 - DNA, 25 bp, Homo sapiens
agctgcagataagtggccttgacac

SEQ ID NO: 3800 - DNA, 25 bp, Homo sapiens
gctgcagataagtggccttgacaca

SEQ ID NO: 3801 - DNA, 25 bp, Homo sapiens
agataagtggccttgacacattaca

SEQ ID NO: 3802 - DNA, 25 bp, Homo sapiens
ataagtggccttgacacattacaag

SEQ ID NO: 3803 - DNA, 25 bp, Homo sapiens
aagtggccttgacacattacaagcc

SEQ ID NO: 3804 - DNA, 25 bp, Homo sapiens
ttggacagacacagagggacccttg

SEQ ID NO: 3805 - DNA, 25 bp, Homo sapiens
ccttggctcctgtgtctggtccaca

SEQ ID NO: 3806 - DNA, 25 bp, Homo sapiens
cttggctcctgtgtctggtccacac

SEQ ID NO: 3807 - DNA, 25 bp, Homo sapiens
tggctcctgtgtctggtccacacac

SEQ ID NO: 3808 - DNA, 25 bp, Homo sapiens
tgtctggtccacacaccacagaagc

SEQ ID NO: 3809 - DNA, 25 bp, Homo sapiens
gtccacacaccacagaagcttgtat

SEQ ID NO: 3810 - DNA, 25 bp, Homo sapiens
acaccacagaagcttgtattatcag

SEQ ID NO: 3811 - DNA, 25 bp, Homo sapiens
caccacagaagcttgtattatcagt

SEQ ID NO: 3812 - DNA, 25 bp, Homo sapiens
accacagaagcttgtattatcagtg

SEQ ID NO: 3813 - DNA, 25 bp, Homo sapiens
gtactacatttgcatgccttttggg

SEQ ID NO: 3814 - DNA, 25 bp, Homo sapiens
atttgcatgccttttgggtttgcct

SEQ ID NO: 3815 - DNA, 25 bp, Homo sapiens
ttgcatgccttttgggtttgcctta

SEQ ID NO: 3816 - DNA, 25 bp, Homo sapiens
gggtttgccttaattcttacctcat

SEQ ID NO: 3817 - DNA, 25 bp, Homo sapiens
cctgctaaatgacttattgattaag

SEQ ID NO: 3818 - DNA, 25 bp, Homo sapiens
ttaaaattgcagcagttgctagcaa

SEQ ID NO: 3819 - DNA, 25 bp, Homo sapiens
aattgcagcagttgctagcaacaac

SEQ ID NO: 3820 - DNA, 25 bp, Homo sapiens
gagattcataaatcttctatattga

SEQ ID NO: 3821 - DNA, 25 bp, Homo sapiens
taaatcttctatattgagaattggc

SEQ ID NO: 3822 - DNA, 25 bp, Homo sapiens
aatcttctatattgagaattggcta

SEQ ID NO: 3823 - DNA, 25 bp, Homo sapiens
tcttctatattgagaattggctatg

SEQ ID NO: 3824 - DNA, 25 bp, Homo sapiens
taagtttgattcatgctgtctgtta

SEQ ID NO: 3825 - DNA, 25 bp, Homo sapiens
agtttgattcatgctgtctgttaaa

SEQ ID NO: 3826 - DNA, 25 bp, Homo sapiens
gtttgattcatgctgtctgttaaat

SEQ ID NO: 3827 - DNA, 25 bp, Homo sapiens
attcatgctgtctgttaaatcaaaa

SEQ ID NO: 3828 - DNA, 25 bp, Homo sapiens
tcatgctgtctgttaaatcaaaact

SEQ ID NO: 3829 - DNA, 25 bp, Homo sapiens
ctcatgagtagcatccacattttta

SEQ ID NO: 3830 - DNA, 25 bp, Homo sapiens
tcatgagtagcatccacatttttaa

SEQ ID NO: 3831 - DNA, 25 bp, Homo sapiens
catgagtagcatccacatttttaaa

SEQ ID NO: 3832 - DNA, 25 bp, Homo sapiens
gtagcatccacatttttaaaatttc

SEQ ID NO: 3833 - DNA, 25 bp, Homo sapiens
agcatccacatttttaaaatttcaa

SEQ ID NO: 3834 - DNA, 25 bp, Homo sapiens
catccacatttttaaaatttcaaat

SEQ ID NO: 3835 - DNA, 25 bp, Homo sapiens
tccacatttttaaaatttcaaattg

SEQ ID NO: 3836 - DNA, 25 bp, Homo sapiens
tgagactagcaattagttggctgct

SEQ ID NO: 3837 - DNA, 25 bp, Homo sapiens
ctagcaattagttggctgctcccta

SEQ ID NO: 3838 - DNA, 25 bp, Homo sapiens
aatatgacaggcttaagtactgctg

SEQ ID NO: 3839 - DNA, 25 bp, Homo sapiens
atgacaggcttaagtactgctgtcc

SEQ ID NO: 3840 - DNA, 25 bp, Homo sapiens
ggcttaagtactgctgtccttttgc

SEQ ID NO: 3841 - DNA, 25 bp, Homo sapiens
tgctgtccttttgcatcttcctaag

SEQ ID NO: 3842 - DNA, 25 bp, Homo sapiens
gctgtccttttgcatcttcctaagc

SEQ ID NO: 3843 - DNA, 25 bp, Homo sapiens
gcatcttcctaagcatcttggttaa

SEQ ID NO: 3844 - DNA, 25 bp, Homo sapiens
cctaagcatcttggttaaatttctg

SEQ ID NO: 3845 - DNA, 25 bp, Homo sapiens
ctaagcatcttggttaaatttctga

SEQ ID NO: 3846 - DNA, 25 bp, Homo sapiens
tctattaggtccattggcaaagtat

SEQ ID NO: 3847 - DNA, 25 bp, Homo sapiens
tccattggcaaagtatattggtcca

SEQ ID NO: 3848 - DNA, 25 bp, Homo sapiens
ttaagattcctttattgtggtacca

SEQ ID NO: 3849 - DNA, 25 bp, Homo sapiens
agattcctttattgtggtaccatgt

SEQ ID NO: 3850 - DNA, 25 bp, Homo sapiens
gattcctttattgtggtaccatgtc

SEQ ID NO: 3851 - DNA, 25 bp, Homo sapiens
ctcccggtcacacaacagggtacgt

SEQ ID NO: 3852 - DNA, 25 bp, Homo sapiens
tcaagaccaagttcctctctgagat

SEQ ID NO: 3853 - DNA, 25 bp, Homo sapiens
cctctctgagatcgaaagtgacagc

SEQ ID NO: 3854 - DNA, 25 bp, Homo sapiens
aggtccgagccatcctagaggatct

SEQ ID NO: 3855 - DNA, 25 bp, Homo sapiens
gctgtgtcccagagggctgcccagc

SEQ ID NO: 3856 - DNA, 25 bp, Homo sapiens
ccctcgctgtgtggtcacgttcctg

SEQ ID NO: 3857 - DNA, 25 bp, Homo sapiens
ctgtgtggtcacgttcctgcagtca

SEQ ID NO: 3858 - DNA, 25 bp, Homo sapiens
aggtgcggccctggtcaccgctgtt

SEQ ID NO: 3859 - DNA, 25 bp, Homo sapiens
agttgactcgtgtctgaggaaacct

SEQ ID NO: 3860 - DNA, 25 bp, Homo sapiens
tgactcgtgtctgaggaaacctcca

SEQ ID NO: 3861 - DNA, 25 bp, Homo sapiens
tcgtgtctgaggaaacctccaggct

SEQ ID NO: 3862 - DNA, 25 bp, Homo sapiens
acctccaggctgaggaggtctccgc

SEQ ID NO: 3863 - DNA, 25 bp, Homo sapiens
ctccaggctgaggaggtctccgccg

SEQ ID NO: 3864 - DNA, 25 bp, Homo sapiens
ggccatttggccttgctccctggct

SEQ ID NO: 3865 - DNA, 25 bp, Homo sapiens
gccatttggccttgctccctggctt

SEQ ID NO: 3866 - DNA, 25 bp, Homo sapiens
tggctttccctgagagaagtagcac

SEQ ID NO: 3867 - DNA, 25 bp, Homo sapiens
agaagtagcactcaggttagcaata

SEQ ID NO: 3868 - DNA, 25 bp, Homo sapiens
tccaaagttgtttccagaaattggt

SEQ ID NO: 3869 - DNA, 25 bp, Homo sapiens
ccacctactccattgctttatgagg

SEQ ID NO: 3870 - DNA, 25 bp, Homo sapiens
ctccattgctttatgaggtttaagg

SEQ ID NO: 3871 - DNA, 25 bp, Homo sapiens
aatccaacttctgaccgcccagtag

SEQ ID NO: 3872 - DNA, 25 bp, Homo sapiens
ttctgaccgcccagtaggaagaaaa

SEQ ID NO: 3873 - DNA, 25 bp, Homo sapiens
tgagacattttttccattacagaga

SEQ ID NO: 3874 - DNA, 25 bp, Homo sapiens
tccattacagagaaatgcttcttga

SEQ ID NO: 3875 - DNA, 25 bp, Homo sapiens
ttacagagaaatgcttcttgacttt

SEQ ID NO: 3876 - DNA, 25 bp, Homo sapiens
agagaaatgcttcttgactttaaca

SEQ ID NO: 3877 - DNA, 25 bp, Homo sapiens
gagaaatgcttcttgactttaacat

SEQ ID NO: 3878 - DNA, 25 bp, Homo sapiens
agtgaactgctggaactcacacatg

SEQ ID NO: 3879 - DNA, 25 bp, Homo sapiens
ggaactcacacatgccctgatatgt

SEQ ID NO: 3880 - DNA, 25 bp, Homo sapiens
tcacacatgccctgatatgtaaatg

SEQ ID NO: 3881 - DNA, 25 bp, Homo sapiens
cacacatgccctgatatgtaaatga

SEQ ID NO: 3882 - DNA, 25 bp, Homo sapiens
catgccctgatatgtaaatgatgat

SEQ ID NO: 3883 - DNA, 25 bp, Homo sapiens
tatgttggcgagtctgagagcaagc

SEQ ID NO: 3884 - DNA, 25 bp, Homo sapiens
aggctgtgacatcaatgctatcatc

SEQ ID NO: 3885 - DNA, 25 bp, Homo sapiens
aaagttgtctgtgtgcgcaaatcca

SEQ ID NO: 3886 - DNA, 25 bp, Homo sapiens
gtgtgcgcaaatccaaaacagactt

SEQ ID NO: 3887 - DNA, 25 bp, Homo sapiens
gcgtctcctcagtaaaaaagtcaag

SEQ ID NO: 3888 - DNA, 25 bp, Homo sapiens
ggaattggacatagcccaagaacag

SEQ ID NO: 3889 - DNA, 25 bp, Homo sapiens
tggacatagcccaagaacagaaaga

SEQ ID NO: 3890 - DNA, 25 bp, Homo sapiens
cttgcacatcatggagggtttagtg

SEQ ID NO: 3891 - DNA, 25 bp, Homo sapiens
tcatagtttgctttgtttaagcatc

SEQ ID NO: 3892 - DNA, 25 bp, Homo sapiens
gctttgtttaagcatcacattaaag

SEQ ID NO: 3893 - DNA, 25 bp, Homo sapiens
tccataagctattttggtttagtgc

SEQ ID NO: 3894 - DNA, 25 bp, Homo sapiens
ccataagctattttggtttagtgca

SEQ ID NO: 3895 - DNA, 25 bp, Homo sapiens
agattatatggactttcttgcaagc

SEQ ID NO: 3896 - DNA, 25 bp, Homo sapiens
attatatggactttcttgcaagcaa

SEQ ID NO: 3897 - DNA, 25 bp, Homo sapiens
tggactttcttgcaagcaacaagct

SEQ ID NO: 3898 - DNA, 25 bp, Homo sapiens
ggactttcttgcaagcaacaagcta

SEQ ID NO: 3899 - DNA, 25 bp, Homo sapiens
ttgtctcctaaattgttgtaattgc

SEQ ID NO: 3900 - DNA, 25 bp, Homo sapiens
ttaattcatccaaatgtactgaggt

SEQ ID NO: 3901 - DNA, 25 bp, Homo sapiens
ttaccacacacttgactacggatgt

SEQ ID NO: 3902 - DNA, 25 bp, Homo sapiens
tgactacggatgtgatcaacactaa

SEQ ID NO: 3903 - DNA, 25 bp, Homo sapiens
ttgagccagggcaggcctcagacac

SEQ ID NO: 3904 - DNA, 25 bp, Homo sapiens
gcccggaatgccagtgctccgagct

SEQ ID NO: 3905 - DNA, 25 bp, Homo sapiens
cggaatgccagtgctccgagctcag

SEQ ID NO: 3906 - DNA, 25 bp, Homo sapiens
gctccgagctcagacagaggaagcc

SEQ ID NO: 3907 - DNA, 25 bp, Homo sapiens
tcagacagaggaagccctgcagaaa

SEQ ID NO: 3908 - DNA, 25 bp, Homo sapiens
ttttagcacagttcatagtccacag

SEQ ID NO: 3909 - DNA, 25 bp, Homo sapiens
ttagcacagttcatagtccacagtt

SEQ ID NO: 3910 - DNA, 25 bp, Homo sapiens
cagttcatagtccacagttgatgca

SEQ ID NO: 3911 - DNA, 25 bp, Homo sapiens
cacagttgatgcagcatcctgagat

SEQ ID NO: 3912 - DNA, 25 bp, Homo sapiens
ttgatgcagcatcctgagattttaa

SEQ ID NO: 3913 - DNA, 25 bp, Homo sapiens
tgatgcagcatcctgagattttaaa

SEQ ID NO: 3914 - DNA, 25 bp, Homo sapiens
gtggcgcacacaccaagtagggagc

SEQ ID NO: 3915 - DNA, 25 bp, Homo sapiens
cgcacacaccaagtagggagctagt

SEQ ID NO: 3916 - DNA, 25 bp, Homo sapiens
ttaaaaatgcatgcaaactgaaagc

SEQ ID NO: 3917 - DNA, 25 bp, Homo sapiens
gagtttggttttgcaaccggaggca

SEQ ID NO: 3918 - DNA, 25 bp, Homo sapiens
agtttggttttgcaaccggaggcag

SEQ ID NO: 3919 - DNA, 25 bp, Homo sapiens
gtttggttttgcaaccggaggcaga

SEQ ID NO: 3920 - DNA, 25 bp, Homo sapiens
tttggttttgcaaccggaggcagag

SEQ ID NO: 3921 - DNA, 25 bp, Homo sapiens
ttttgcaaccggaggcagagagaaa

SEQ ID NO: 3922 - DNA, 25 bp, Homo sapiens
gcaaccggaggcagagagaaaaacg

SEQ ID NO: 3923 - DNA, 25 bp, Homo sapiens
caaccggaggcagagagaaaaacgg

SEQ ID NO: 3924 - DNA, 25 bp, Homo sapiens
ttctatttctaaggaacatcttgag

SEQ ID NO: 3925 - DNA, 25 bp, Homo sapiens
tctatttctaaggaacatcttgagt

SEQ ID NO: 3926 - DNA, 25 bp, Homo sapiens
ctatttctaaggaacatcttgagtg

SEQ ID NO: 3927 - DNA, 25 bp, Homo sapiens
tatttctaaggaacatcttgagtgc

SEQ ID NO: 3928 - DNA, 25 bp, Homo sapiens
tttctaaggaacatcttgagtgcag

SEQ ID NO: 3929 - DNA, 25 bp, Homo sapiens
ttctaaggaacatcttgagtgcaga

SEQ ID NO: 3930 - DNA, 25 bp, Homo sapiens
tctaaggaacatcttgagtgcagat

SEQ ID NO: 3931 - DNA, 25 bp, Homo sapiens
ctaaggaacatcttgagtgcagata

SEQ ID NO: 3932 - DNA, 25 bp, Homo sapiens
tccctagttcggaaattcaagctaa

SEQ ID NO: 3933 - DNA, 25 bp, Homo sapiens
tttaaactgtcactgcatatgcaag

SEQ ID NO: 3934 - DNA, 25 bp, Homo sapiens
cgctctaatttttggatcattaaag

SEQ ID NO: 3935 - DNA, 25 bp, Homo sapiens
aggtaacaaaacaaccacctgatag

SEQ ID NO: 3936 - DNA, 25 bp, Homo sapiens
accacctgatagtaagttttctgat

SEQ ID NO: 3937 - DNA, 25 bp, Homo sapiens
agaggtaatcaattcttccgaagtg

SEQ ID NO: 3938 - DNA, 25 bp, Homo sapiens
caatgtatttccttcatgagtaaag

SEQ ID NO: 3939 - DNA, 25 bp, Homo sapiens
agtatagattccagtagcctagttt

SEQ ID NO: 3940 - DNA, 25 bp, Homo sapiens
cagcacgataacaccatgacgccta

SEQ ID NO: 3941 - DNA, 25 bp, Homo sapiens
gataacaccatgacgcctactgctg

SEQ ID NO: 3942 - DNA, 25 bp, Homo sapiens
accttgggattctgtgtgctgccat

SEQ ID NO: 3943 - DNA, 25 bp, Homo sapiens
ctgtcaggcagcagcgaaagcttgt

SEQ ID NO: 3944 - DNA, 25 bp, Homo sapiens
agcgaaagcttgttaggatgtcctg

SEQ ID NO: 3945 - DNA, 25 bp, Homo sapiens
ttaggatgtcctgtgctgcttgtga

SEQ ID NO: 3946 - DNA, 25 bp, Homo sapiens
atgagagcctccacactgtactgtt

SEQ ID NO: 3947 - DNA, 25 bp, Homo sapiens
gcctccacactgtactgttcaagtc

SEQ ID NO: 3948 - DNA, 25 bp, Homo sapiens
gcaaccggaggcagagagaaaaacg

SEQ ID NO: 3949 - DNA, 25 bp, Homo sapiens
caaccggaggcagagagaaaaacgg

SEQ ID NO: 3950 - DNA, 25 bp, Homo sapiens
ttctatttctaaggaacatcttgag

SEQ ID NO: 3951 - DNA, 25 bp, Homo sapiens
tctatttctaaggaacatcttgagt

SEQ ID NO: 3952 - DNA, 25 bp, Homo sapiens
ctatttctaaggaacatcttgagtg

SEQ ID NO: 3953 - DNA, 25 bp, Homo sapiens
tatttctaaggaacatcttgagtgc

SEQ ID NO: 3954 - DNA, 25 bp, Homo sapiens
tttctaaggaacatcttgagtgcag

SEQ ID NO: 3955 - DNA, 25 bp, Homo sapiens
ttctaaggaacatcttgagtgcaga

SEQ ID NO: 3956 - DNA, 25 bp, Homo sapiens
tctaaggaacatcttgagtgcagat

SEQ ID NO: 3957 - DNA, 25 bp, Homo sapiens
ctaaggaacatcttgagtgcagata

SEQ ID NO: 3958 - DNA, 25 bp, Homo sapiens
tcacacacacgcagacatatgagta

SEQ ID NO: 3959 - DNA, 25 bp, Homo sapiens
gagtttggttttgcaaccggaggca

SEQ ID NO: 3960 - DNA, 25 bp, Homo sapiens
agtttggttttgcaaccggaggcag

SEQ ID NO: 3961 - DNA, 25 bp, Homo sapiens
gtttggttttgcaaccggaggcaga

SEQ ID NO: 3962 - DNA, 25 bp, Homo sapiens
tttggttttgcaaccggaggcagag

SEQ ID NO: 3963 - DNA, 25 bp, Homo sapiens
ttttgcaaccggaggcagagagaaa

SEQ ID NO: 3964 - DNA, 25 bp, Homo sapiens
aaagttcaggtagttcatctagttc

SEQ ID NO: 3965 - DNA, 25 bp, Homo sapiens
agttcaggtagttcatctagttctt

SEQ ID NO: 3966 - DNA, 25 bp, Homo sapiens
gttcaggtagttcatctagttcttc

SEQ ID NO: 3967 - DNA, 25 bp, Homo sapiens
ttcaggtagttcatctagttcttcc

SEQ ID NO: 3968 - DNA, 25 bp, Homo sapiens
tcaggtagttcatctagttcttcct

SEQ ID NO: 3969 - DNA, 25 bp, Homo sapiens
caggtagttcatctagttcttcctc

SEQ ID NO: 3970 - DNA, 25 bp, Homo sapiens
aggtagttcatctagttcttcctcc

SEQ ID NO: 3971 - DNA, 25 bp, Homo sapiens
ggtagttcatctagttcttcctcct

SEQ ID NO: 3972 - DNA, 25 bp, Homo sapiens
tagttcttcctcctctgttaagcag

SEQ ID NO: 3973 - DNA, 25 bp, Homo sapiens
gttcttcctcctctgttaagcagta

SEQ ID NO: 3974 - DNA, 25 bp, Homo sapiens
cccctgtcacataccaggtgggcta

SEQ ID NO: 3975 - DNA, 25 bp, Homo sapiens
ccctgtcacataccaggtgggctac

SEQ ID NO: 3976 - DNA, 25 bp, Homo sapiens
cctgtcacataccaggtgggctacg

SEQ ID NO: 3977 - DNA, 25 bp, Homo sapiens
ctgtcacataccaggtgggctacgg

SEQ ID NO: 3978 - DNA, 25 bp, Homo sapiens
tgtcacataccaggtgggctacgga

SEQ ID NO: 3979 - DNA, 25 bp, Homo sapiens
gtcacataccaggtgggctacggac

SEQ ID NO: 3980 - DNA, 25 bp, Homo sapiens
ttcatatggcagcaagaattattgc

SEQ ID NO: 3981 - DNA, 25 bp, Homo sapiens
tcatatggcagcaagaattattgcc

SEQ ID NO: 3982 - DNA, 25 bp, Homo sapiens
agaattattgccaagttagcagctt

SEQ ID NO: 3983 - DNA, 25 bp, Homo sapiens
gaattattgccaagttagcagcttg

SEQ ID NO: 3984 - DNA, 25 bp, Homo sapiens
aattattgccaagttagcagcttgg

SEQ ID NO: 3985 - DNA, 25 bp, Homo sapiens
attattgccaagttagcagcttggg

SEQ ID NO: 3986 - DNA, 25 bp, Homo sapiens
ttattgccaagttagcagcttgggg

SEQ ID NO: 3987 - DNA, 25 bp, Homo sapiens
tattgccaagttagcagcttgggga

SEQ ID NO: 3988 - DNA, 25 bp, Homo sapiens
attgccaagttagcagcttggggaa

SEQ ID NO: 3989 - DNA, 25 bp, Homo sapiens
ttgccaagttagcagcttggggaaa

SEQ ID NO: 3990 - DNA, 25 bp, Homo sapiens
tgccaagttagcagcttggggaaaa

SEQ ID NO: 3991 - DNA, 25 bp, Homo sapiens
gccaagttagcagcttggggaaaag

SEQ ID NO: 3992 - DNA, 25 bp, Homo sapiens
ccaagttagcagcttggggaaaaga

SEQ ID NO: 3993 - DNA, 25 bp, Homo sapiens
actcagctgagttcacagagttcgc

SEQ ID NO: 3994 - DNA, 25 bp, Homo sapiens
ctaaactggagtgatgttagcagac

SEQ ID NO: 3995 - DNA, 25 bp, Homo sapiens
agacccagcttagagttcttctttc

SEQ ID NO: 3996 - DNA, 25 bp, Homo sapiens
agcttctccaagcatcaccctggga

SEQ ID NO: 3997 - DNA, 25 bp, Homo sapiens
gcttctccaagcatcaccctgggag

SEQ ID NO: 3998 - DNA, 25 bp, Homo sapiens
ttttctcataaatgagggctgcaca

SEQ ID NO: 3999 - DNA, 25 bp, Homo sapiens
ctgttctgcttcgaagtattcaata

SEQ ID NO: 4000 - DNA, 25 bp, Homo sapiens
gaagtattcaataccgctcagtatt

SEQ ID NO: 4001 - DNA, 25 bp, Homo sapiens
gaaagcatatgcagccaaccaagat

SEQ ID NO: 4002 - DNA, 25 bp, Homo sapiens
ccaaccaagatgcaaatgttttgaa

SEQ ID NO: 4003 - DNA, 25 bp, Homo sapiens
ggaaagtcacccaaacacttctgct

SEQ ID NO: 4004 - DNA, 25 bp, Homo sapiens
atactgtaggaacaagcatgatctt

SEQ ID NO: 4005 - DNA, 25 bp, Homo sapiens
ccaaatgatcctagtaattgcctag

SEQ ID NO: 4006 - DNA, 25 bp, Homo sapiens
aatgatcctagtaattgcctagaaa

SEQ ID NO: 4007 - DNA, 25 bp, Homo sapiens
gatcctagtaattgcctagaaatat

SEQ ID NO: 4008 - DNA, 25 bp, Homo sapiens
tttttatactgtatgtgccaaagct

SEQ ID NO: 4009 - DNA, 25 bp, Homo sapiens
tttatactgtatgtgccaaagcttt

SEQ ID NO: 4010 - DNA, 25 bp, Homo sapiens
aggacctctgctgctgccactgtca

SEQ ID NO: 4011 - DNA, 25 bp, Homo sapiens
gacctctgctgctgccactgtcatt

SEQ ID NO: 4012 - DNA, 25 bp, Homo sapiens
tctgctgctgccactgtcattgtgg

SEQ ID NO: 4013 - DNA, 25 bp, Homo sapiens
ctgccactgtcattgtggttaatga

SEQ ID NO: 4014 - DNA, 25 bp, Homo sapiens
gccactgtcattgtggttaatgatg

SEQ ID NO: 4015 - DNA, 25 bp, Homo sapiens
ccactgtcattgtggttaatgatgg

SEQ ID NO: 4016 - DNA, 25 bp, Homo sapiens
cactgtcattgtggttaatgatggc

SEQ ID NO: 4017 - DNA, 25 bp, Homo sapiens
ttcttattcccgtatctttgagaga

SEQ ID NO: 4018 - DNA, 25 bp, Homo sapiens
attcccgtatctttgagagaggaag

SEQ ID NO: 4019 - DNA, 25 bp, Homo sapiens
cccgtatctttgagagaggaagaga

SEQ ID NO: 4020 - DNA, 25 bp, Homo sapiens
ccagggtgcctagacaagaggtagc

SEQ ID NO: 4021 - DNA, 25 bp, Homo sapiens
cagggtgcctagacaagaggtagca

SEQ ID NO: 4022 - DNA, 25 bp, Homo sapiens
ggtgcctagacaagaggtagcagcc

SEQ ID NO: 4023 - DNA, 25 bp, Homo sapiens
tgcctagacaagaggtagcagcctg

SEQ ID NO: 4024 - DNA, 25 bp, Homo sapiens
agacaagaggtagcagcctgtggat

SEQ ID NO: 4025 - DNA, 25 bp, Homo sapiens
acaagaggtagcagcctgtggatgt

SEQ ID NO: 4026 - DNA, 25 bp, Homo sapiens
ccagtgccatcaatggcaacccatc

SEQ ID NO: 4027 - DNA, 25 bp, Homo sapiens
ccatcaatggcaacccatcctggca

SEQ ID NO: 4028 - DNA, 25 bp, Homo sapiens
acccatcctggcacctggcagacag

SEQ ID NO: 4029 - DNA, 25 bp, Homo sapiens
cggtgaatggagccactgcgcacag

SEQ ID NO: 4030 - DNA, 25 bp, Homo sapiens
cgcacagcagcagtttggatgcccg

SEQ ID NO: 4031 - DNA, 25 bp, Homo sapiens
cattcagtgacctgacatcccagct

SEQ ID NO: 4032 - DNA, 25 bp, Homo sapiens
tcaccccagggacagcatatcagag

SEQ ID NO: 4033 - DNA, 25 bp, Homo sapiens
gtcggatcgcagcttggatggccac

SEQ ID NO: 4034 - DNA, 25 bp, Homo sapiens
tcgcagcttggatggccacttacct

SEQ ID NO: 4035 - DNA, 25 bp, Homo sapiens
cttggatggccacttacctgaatga

SEQ ID NO: 4036 - DNA, 25 bp, Homo sapiens
tggccacttacctgaatgaccacct

SEQ ID NO: 4037 - DNA, 25 bp, Homo sapiens
tgaatgaccacctagagccttggat

SEQ ID NO: 4038 - DNA, 25 bp, Homo sapiens
ggaacaatgcagcagccgagagccg

SEQ ID NO: 4039 - DNA, 25 bp, Homo sapiens
atgcagcagccgagagccgaaaggg

SEQ ID NO: 4040 - DNA, 25 bp, Homo sapiens
tcctgacgggcatgactgtggccgg

SEQ ID NO: 4041 - DNA, 25 bp, Homo sapiens
tgactgtggccggcgtggttctgct

SEQ ID NO: 4042 - DNA, 25 bp, Homo sapiens
ggggtaatcaccttaaaatgtcatc

SEQ ID NO: 4043 - DNA, 25 bp, Homo sapiens
atcaccttaaaatgtcatcaaaaat

SEQ ID NO: 4044 - DNA, 25 bp, Homo sapiens
catcaaaaatagatctactagaagg

SEQ ID NO: 4045 - DNA, 25 bp, Homo sapiens
agatctactagaaggcagcatcaca

SEQ ID NO: 4046 - DNA, 25 bp, Homo sapiens
ctactagaaggcagcatcacattcc

SEQ ID NO: 4047 - DNA, 25 bp, Homo sapiens
tagaaggcagcatcacattcccatc

SEQ ID NO: 4048 - DNA, 25 bp, Homo sapiens
ggcagcatcacattcccatcttact

SEQ ID NO: 4049 - DNA, 25 bp, Homo sapiens
cacattcccatcttacttatggact

SEQ ID NO: 4050 - DNA, 25 bp, Homo sapiens
tcccatcttacttatggactcctac

SEQ ID NO: 4051 - DNA, 25 bp, Homo sapiens
cctggttcatgtcttatatgcctgt

SEQ ID NO: 4052 - DNA, 25 bp, Homo sapiens
ttcatgtcttatatgcctgtaatgg

SEQ ID NO: 4053 - DNA, 25 bp, Homo sapiens
tatatgcctgtaatggttataaagc

SEQ ID NO: 4054 - DNA, 25 bp, Homo sapiens
gttataaagcctaccttcaggaaag

SEQ ID NO: 4055 - DNA, 25 bp, Homo sapiens
aaagcctaccttcaggaaagctatg

SEQ ID NO: 4056 - DNA, 25 bp, Homo sapiens
ctaccttcaggaaagctatggttga

SEQ ID NO: 4057 - DNA, 25 bp, Homo sapiens
ttttaaacatgtccctctacaataa

SEQ ID NO: 4058 - DNA, 25 bp, Homo sapiens
cctagaggtttctaggagagagtac

SEQ ID NO: 4059 - DNA, 25 bp, Homo sapiens
tgtctcagatcaaaatcttgacccg

SEQ ID NO: 4060 - DNA, 25 bp, Homo sapiens
gtctcagatcaaaatcttgacccga

SEQ ID NO: 4061 - DNA, 25 bp, Homo sapiens
tctcagatcaaaatcttgacccgag

SEQ ID NO: 4062 - DNA, 25 bp, Homo sapiens
ctcagatcaaaatcttgacccgagg

SEQ ID NO: 4063 - DNA, 25 bp, Homo sapiens
tcagatcaaaatcttgacccgaggc

SEQ ID NO: 4064 - DNA, 25 bp, Homo sapiens
cagatcaaaatcttgacccgaggcc

SEQ ID NO: 4065 - DNA, 25 bp, Homo sapiens
agatcaaaatcttgacccgaggcct

SEQ ID NO: 4066 - DNA, 25 bp, Homo sapiens
gatcaaaatcttgacccgaggcctc

SEQ ID NO: 4067 - DNA, 25 bp, Homo sapiens
atcaaaatcttgacccgaggcctca

SEQ ID NO: 4068 - DNA, 25 bp, Homo sapiens
caccaatacgtacagggaagatatc

SEQ ID NO: 4069 - DNA, 25 bp, Homo sapiens
accaatacgtacagggaagatatct

SEQ ID NO: 4070 - DNA, 25 bp, Homo sapiens
gggcattatatgctaccgatattag

SEQ ID NO: 4071 - DNA, 25 bp, Homo sapiens
ggcattatatgctaccgatattagg

SEQ ID NO: 4072 - DNA, 25 bp, Homo sapiens
gcattatatgctaccgatattagga

SEQ ID NO: 4073 - DNA, 25 bp, Homo sapiens
cagtttgaatatcctttgtttcaga

SEQ ID NO: 4074 - DNA, 25 bp, Homo sapiens
gaatatcctttgtttcagagccaga

SEQ ID NO: 4075 - DNA, 25 bp, Homo sapiens
aatatcctttgtttcagagccagat

SEQ ID NO: 4076 - DNA, 25 bp, Homo sapiens
tatcctttgtttcagagccagatca

SEQ ID NO: 4077 - DNA, 25 bp, Homo sapiens
atcctttgtttcagagccagatcat

SEQ ID NO: 4078 - DNA, 25 bp, Homo sapiens
tcctttgtttcagagccagatcatt

SEQ ID NO: 4079 - DNA, 25 bp, Homo sapiens
cctttgtttcagagccagatcattt

SEQ ID NO: 4080 - DNA, 25 bp, Homo sapiens
gaaagtgtaggcttacctcaaataa

SEQ ID NO: 4081 - DNA, 25 bp, Homo sapiens
tgggcacctcagattgttgttgtta

SEQ ID NO: 4082 - DNA, 25 bp, Homo sapiens
gcattccttcttctggtcagaaacc

SEQ ID NO: 4083 - DNA, 25 bp, Homo sapiens
ctggtcagaaacctgtccactgggc

SEQ ID NO: 4084 - DNA, 25 bp, Homo sapiens
acttatgttgttctctatggagaac

SEQ ID NO: 4085 - DNA, 25 bp, Homo sapiens
cttatgttgttctctatggagaact

SEQ ID NO: 4086 - DNA, 25 bp, Homo sapiens
aagtggctatgcagtttgaatatcc

SEQ ID NO: 4087 - DNA, 25 bp, Homo sapiens
agtggctatgcagtttgaatatcct

SEQ ID NO: 4088 - DNA, 25 bp, Homo sapiens
tgcagtttgaatatcctttgtttca

SEQ ID NO: 4089 - DNA, 25 bp, Homo sapiens
gccttggttgcttaacattatttgt

SEQ ID NO: 4090 - DNA, 25 bp, Homo sapiens
ccttggttgcttaacattatttgta

SEQ ID NO: 4091 - DNA, 25 bp, Homo sapiens
ccattattttctgcatcttgcatgg

SEQ ID NO: 4092 - DNA, 25 bp, Homo sapiens
ttattttctgcatcttgcatggtgc

SEQ ID NO: 4093 - DNA, 25 bp, Homo sapiens
tattttctgcatcttgcatggtgca

SEQ ID NO: 4094 - DNA, 25 bp, Homo sapiens
tttctgcatcttgcatggtgcacaa

SEQ ID NO: 4095 - DNA, 25 bp, Homo sapiens
catcttgcatggtgcacaatagaat

SEQ ID NO: 4096 - DNA, 25 bp, Homo sapiens
ttgcatggtgcacaatagaatatct

SEQ ID NO: 4097 - DNA, 25 bp, Homo sapiens
ctatgaattctaaagttcggcaaac

SEQ ID NO: 4098 - DNA, 25 bp, Homo sapiens
tgaattctaaagttcggcaaaccaa

SEQ ID NO: 4099 - DNA, 25 bp, Homo sapiens
atataattccaaacactcaggtgtg

SEQ ID NO: 4100 - DNA, 25 bp, Homo sapiens
tataattccaaacactcaggtgtgt

SEQ ID NO: 4101 - DNA, 25 bp, Homo sapiens
tccaaacactcaggtgtgtgaatgc

SEQ ID NO: 4102 - DNA, 25 bp, Homo sapiens
cactcaggtgtgtgaatgcatttaa

SEQ ID NO: 4103 - DNA, 25 bp, Homo sapiens
catgcaattccttcaattatgatgg

SEQ ID NO: 4104 - DNA, 25 bp, Homo sapiens
atgcaattccttcaattatgatgga

SEQ ID NO: 4105 - DNA, 25 bp, Homo sapiens
aggagcgactgctaatcagtatggg

SEQ ID NO: 4106 - DNA, 25 bp, Homo sapiens
agcgactgctaatcagtatggggtt

SEQ ID NO: 4107 - DNA, 25 bp, Homo sapiens
gactgctaatcagtatggggtttcc

SEQ ID NO: 4108 - DNA, 25 bp, Homo sapiens
tcagtatggggtttcctcccgggat

SEQ ID NO: 4109 - DNA, 25 bp, Homo sapiens
ttcctcccgggatggtgaaaatgtt

SEQ ID NO: 4110 - DNA, 25 bp, Homo sapiens
ctcccgggatggtgaaaatgttccg

SEQ ID NO: 4111 - DNA, 25 bp, Homo sapiens
aaatgttccggacctagatactgac

SEQ ID NO: 4112 - DNA, 25 bp, Homo sapiens
tgttccggacctagatactgacgaa

SEQ ID NO: 4113 - DNA, 25 bp, Homo sapiens
tccggacctagatactgacgaaggt

SEQ ID NO: 4114 - DNA, 25 bp, Homo sapiens
aggtagcacgacactgtgagtgcac

SEQ ID NO: 4115 - DNA, 25 bp, Homo sapiens
ttggacactttgaaatggtgaattt

SEQ ID NO: 4116 - DNA, 25 bp, Homo sapiens
atttgctattttatctcacatacat

SEQ ID NO: 4117 - DNA, 25 bp, Homo sapiens
ttctgtccaggttgttcatataata

SEQ ID NO: 4118 - DNA, 25 bp, Homo sapiens
aatatgctgtgagcatctttccatg

SEQ ID NO: 4119 - DNA, 25 bp, Homo sapiens
atgctgtgagcatctttccatgaca

SEQ ID NO: 4120 - DNA, 25 bp, Homo sapiens
ctgtgagcatctttccatgacatta

SEQ ID NO: 4121 - DNA, 25 bp, Homo sapiens
gatgtgaagcgacgagccatggccg

SEQ ID NO: 4122 - DNA, 25 bp, Homo sapiens
aagcgacgagccatggccgaccctg

SEQ ID NO: 4123 - DNA, 25 bp, Homo sapiens
atggccgaccctgaggtgcagcaga

SEQ ID NO: 4124 - DNA, 25 bp, Homo sapiens
gaggtgcagcagatcatgagtgacc

SEQ ID NO: 4125 - DNA, 25 bp, Homo sapiens
agtgacccagccatgcgccttatcc

SEQ ID NO: 4126 - DNA, 25 bp, Homo sapiens
atgcgccttatcctggaacagatgc

SEQ ID NO: 4127 - DNA, 25 bp, Homo sapiens
ctcagcgaacacttaaagaatcctg

SEQ ID NO: 4128 - DNA, 25 bp, Homo sapiens
gatgtgggtctgattgcaattcggt

SEQ ID NO: 4129 - DNA, 25 bp, Homo sapiens
attgcaattcggtgatgacttgttc

SEQ ID NO: 4130 - DNA, 25 bp, Homo sapiens
ccctcatgtggaaagaggagctggg

SEQ ID NO: 4131 - DNA, 25 bp, Homo sapiens
agaaggcctcatctctctatattta

SEQ ID NO: 4132 - DNA, 25 bp, Homo sapiens
gacacagagactcgtacctgcgctg

SEQ ID NO: 4133 - DNA, 25 bp, Homo sapiens
gctgccctcgagttccatgtctctt

SEQ ID NO: 4134 - DNA, 25 bp, Homo sapiens
cctcaggtcccagctgtctcacgtt

SEQ ID NO: 4135 - DNA, 25 bp, Homo sapiens
gtcccagctgtctcacgttgtttat

SEQ ID NO: 4136 - DNA, 25 bp, Homo sapiens
tgtttattctgcgtccccttctcca

SEQ ID NO: 4137 - DNA, 25 bp, Homo sapiens
cctgggccatagtcattctgcctgc

SEQ ID NO: 4138 - DNA, 25 bp, Homo sapiens
ctgggccatagtcattctgcctgcc

SEQ ID NO: 4139 - DNA, 25 bp, Homo sapiens
ggccatagtcattctgcctgccctg

SEQ ID NO: 4140 - DNA, 25 bp, Homo sapiens
ccatagtcattctgcctgccctgaa

SEQ ID NO: 4141 - DNA, 25 bp, Homo sapiens
agtcattctgcctgccctgaaagtc

SEQ ID NO: 4142 - DNA, 25 bp, Homo sapiens
gcctgccctgaaagtcccagatcaa

SEQ ID NO: 4143 - DNA, 25 bp, Homo sapiens
cctgccctgaaagtcccagatcaag

SEQ ID NO: 4144 - DNA, 25 bp, Homo sapiens
ctgccctgaaagtcccagatcaagc

SEQ ID NO: 4145 - DNA, 25 bp, Homo sapiens
cctgaaagtcccagatcaagcctgc

SEQ ID NO: 4146 - DNA, 25 bp, Homo sapiens
ctgaaagtcccagatcaagcctgcc

SEQ ID NO: 4147 - DNA, 25 bp, Homo sapiens
gaaagtcccagatcaagcctgcctc

SEQ ID NO: 4148 - DNA, 25 bp, Homo sapiens
ttatagccaggtaccttctcacctg

SEQ ID NO: 4149 - DNA, 25 bp, Homo sapiens
agccaggtaccttctcacctgtgag

SEQ ID NO: 4150 - DNA, 25 bp, Homo sapiens
gccaggtaccttctcacctgtgaga

SEQ ID NO: 4151 - DNA, 25 bp, Homo sapiens
ctcccaactataaaactaggtgctg

SEQ ID NO: 4152 - DNA, 25 bp, Homo sapiens
aactataaaactaggtgctgcagcc

SEQ ID NO: 4153 - DNA, 25 bp, Homo sapiens
ttccagcccgggagcatcacagagg

SEQ ID NO: 4154 - DNA, 25 bp, Homo sapiens
tccagcccgggagcatcacagaggt

SEQ ID NO: 4155 - DNA, 25 bp, Homo sapiens
ccagcccgggagcatcacagaggtg

SEQ ID NO: 4156 - DNA, 25 bp, Homo sapiens
cagcccgggagcatcacagaggtgt

SEQ ID NO: 4157 - DNA, 25 bp, Homo sapiens
cccgggagcatcacagaggtgtgca

SEQ ID NO: 4158 - DNA, 25 bp, Homo sapiens
ccgggagcatcacagaggtgtgcat

SEQ ID NO: 4159 - DNA, 25 bp, Homo sapiens
cgggagcatcacagaggtgtgcatc

SEQ ID NO: 4160 - DNA, 25 bp, Homo sapiens
gggagcatcacagaggtgtgcatca

SEQ ID NO: 4161 - DNA, 25 bp, Homo sapiens
gagcatcacagaggtgtgcatcacc

SEQ ID NO: 4162 - DNA, 25 bp, Homo sapiens
agcatcacagaggtgtgcatcacct

SEQ ID NO: 4163 - DNA, 25 bp, Homo sapiens
gcatcacagaggtgtgcatcacctt

SEQ ID NO: 4164 - DNA, 25 bp, Homo sapiens
catcacagaggtgtgcatcaccttt

SEQ ID NO: 4165 - DNA, 25 bp, Homo sapiens
atcacagaggtgtgcatcacctttg

SEQ ID NO: 4166 - DNA, 25 bp, Homo sapiens
gaagcgcctcagccaggacgcctat

SEQ ID NO: 4167 - DNA, 25 bp, Homo sapiens
gcaacagcgtccgttttctgcagca

SEQ ID NO: 4168 - DNA, 25 bp, Homo sapiens
ccgccaggcgcggccgggaccgcag

SEQ ID NO: 4169 - DNA, 25 bp, Homo sapiens
gccgggaccgcagagccccgggagc

SEQ ID NO: 4170 - DNA, 25 bp, Homo sapiens
cagagccccgggagcccgctcgagg

SEQ ID NO: 4171 - DNA, 25 bp, Homo sapiens
tcgaggaggagcggcagacgcagcg

SEQ ID NO: 4172 - DNA, 25 bp, Homo sapiens
taaaccgcagccggcggtgcccccg

SEQ ID NO: 4173 - DNA, 25 bp, Homo sapiens
cgcagccggcggtgcccccgcggcc

SEQ ID NO: 4174 - DNA, 25 bp, Homo sapiens
cccccgcggccgagcgccgacctca

SEQ ID NO: 4175 - DNA, 25 bp, Homo sapiens
cctgaaccgctgcagcgagagcacc

SEQ ID NO: 4176 - DNA, 25 bp, Homo sapiens
gaaccgctgcagcgagagcaccaag

SEQ ID NO: 4177 - DNA, 25 bp, Homo sapiens
ccccagctagcgtctcggcccttgc

SEQ ID NO: 4178 - DNA, 25 bp, Homo sapiens
tagcgtctcggcccttgccgccccg

SEQ ID NO: 4179 - DNA, 25 bp, Homo sapiens
cgtctggacgccgagggcagccccg

SEQ ID NO: 4180 - DNA, 25 bp, Homo sapiens
acgccgagggcagccccgacccctg

SEQ ID NO: 4181 - DNA, 25 bp, Homo sapiens
cccgccaccctcaataaatgttgct

SEQ ID NO: 4182 - DNA, 25 bp, Homo sapiens
atttgttcctccttgacaaaagtag

SEQ ID NO: 4183 - DNA, 25 bp, Homo sapiens
gtgtaaactcaccagtcttgctttg

SEQ ID NO: 4184 - DNA, 25 bp, Homo sapiens
actcaccagtcttgctttggagtga

SEQ ID NO: 4185 - DNA, 25 bp, Homo sapiens
caccagtcttgctttggagtgagca

SEQ ID NO: 4186 - DNA, 25 bp, Homo sapiens
cagtcttgctttggagtgagcagaa

SEQ ID NO: 4187 - DNA, 25 bp, Homo sapiens
gaatgactattttacgtggagcatc

SEQ ID NO: 4188 - DNA, 25 bp, Homo sapiens
tgactattttacgtggagcatcatt

SEQ ID NO: 4189 - DNA, 25 bp, Homo sapiens
ctattttacgtggagcatcattgtg

SEQ ID NO: 4190 - DNA, 25 bp, Homo sapiens
tacgtggagcatcattgtgtgactg

SEQ ID NO: 4191 - DNA, 25 bp, Homo sapiens
gagcatcattgtgtgactgttgacc

SEQ ID NO: 4192 - DNA, 25 bp, Homo sapiens
catcattgtgtgactgttgacctgg

SEQ ID NO: 4193 - DNA, 25 bp, Homo sapiens
tgtgtgactgttgacctggacagtc

SEQ ID NO: 4194 - DNA, 25 bp, Homo sapiens
actgttgacctggacagtcccaagg

SEQ ID NO: 4195 - DNA, 25 bp, Homo sapiens
gttgacctggacagtcccaagggct

SEQ ID NO: 4196 - DNA, 25 bp, Homo sapiens
agtcccaagggctatgcagatggac

SEQ ID NO: 4197 - DNA, 25 bp, Homo sapiens
tcccaactgtacagatttgtttgtt

SEQ ID NO: 4198 - DNA, 25 bp, Homo sapiens
cagtgacatagtgcagaggtagcag

SEQ ID NO: 4199 - DNA, 25 bp, Homo sapiens
tgacatagtgcagaggtagcagcag

SEQ ID NO: 4200 - DNA, 25 bp, Homo sapiens
acatagtgcagaggtagcagcagtc

SEQ ID NO: 4201 - DNA, 25 bp, Homo sapiens
catagtgcagaggtagcagcagtca

SEQ ID NO: 4202 - DNA, 25 bp, Homo sapiens
atagtgcagaggtagcagcagtcag

SEQ ID NO: 4203 - DNA, 25 bp, Homo sapiens
tagtgcagaggtagcagcagtcagg

SEQ ID NO: 4204 - DNA, 25 bp, Homo sapiens
cagaggtagcagcagtcaggggtca

SEQ ID NO: 4205 - DNA, 25 bp, Homo sapiens
tcacagatgcccagcctcatagctg

SEQ ID NO: 4206 - DNA, 25 bp, Homo sapiens
gcccagcctcatagctgaagttgcc

SEQ ID NO: 4207 - DNA, 25 bp, Homo sapiens
ctgttgcatgtaacccactggcctc

SEQ ID NO: 4208 - DNA, 25 bp, Homo sapiens
actggcctccctgagcatgtccatt

SEQ ID NO: 4209 - DNA, 25 bp, Homo sapiens
tggcctccctgagcatgtccattga

SEQ ID NO: 4210 - DNA, 25 bp, Homo sapiens
tctctccttgccaaatagtttgtgc

SEQ ID NO: 4211 - DNA, 25 bp, Homo sapiens
ccaaatagtttgtgccttgtcttga

SEQ ID NO: 4212 - DNA, 25 bp, Homo sapiens
tgccaacctcacactgctatgattg

SEQ ID NO: 4213 - DNA, 25 bp, Homo sapiens
acactgctatgattgccaactccag

SEQ ID NO: 4214 - DNA, 25 bp, Homo sapiens
gattgccaactccagcggtcccatg

SEQ ID NO: 4215 - DNA, 25 bp, Homo sapiens
attgccaactccagcggtcccatgt

SEQ ID NO: 4216 - DNA, 25 bp, Homo sapiens
cagcggtcccatgtcagccttctga

SEQ ID NO: 4217 - DNA, 25 bp, Homo sapiens
agcggtcccatgtcagccttctgat

SEQ ID NO: 4218 - DNA, 25 bp, Homo sapiens
catgtcagccttctgatgatcccac

SEQ ID NO: 4219 - DNA, 25 bp, Homo sapiens
tgtcagccttctgatgatcccactc

SEQ ID NO: 4220 - DNA, 25 bp, Homo sapiens
gaatattttcctgaccaagactgag

SEQ ID NO: 4221 - DNA, 25 bp, Homo sapiens
atatttcctctaggttttgcttgac

SEQ ID NO: 4222 - DNA, 25 bp, Homo sapiens
atttcctctaggttttgcttgactc

SEQ ID NO: 4223 - DNA, 25 bp, Homo sapiens
tcctctaggttttgcttgactcaaa

SEQ ID NO: 4224 - DNA, 25 bp, Homo sapiens
ctctaggttttgcttgactcaaagt

SEQ ID NO: 4225 - DNA, 25 bp, Homo sapiens
caaacagtagtaccacgtgtagcat

SEQ ID NO: 4226 - DNA, 25 bp, Homo sapiens
acagtagtaccacgtgtagcatttt

SEQ ID NO: 4227 - DNA, 25 bp, Homo sapiens
gtagtaccacgtgtagcattttgaa

SEQ ID NO: 4228 - DNA, 25 bp, Homo sapiens
taccacgtgtagcattttgaaacat

SEQ ID NO: 4229 - DNA, 25 bp, Homo sapiens
accacgtgtagcattttgaaacatt

SEQ ID NO: 4230 - DNA, 25 bp, Homo sapiens
ccacgtgtagcattttgaaacatta

SEQ ID NO: 4231 - DNA, 25 bp, Homo sapiens
ttttgttacaaacctgtgggcctgt

SEQ ID NO: 4232 - DNA, 25 bp, Homo sapiens
gttacaaacctgtgggcctgttgca

SEQ ID NO: 4233 - DNA, 25 bp, Homo sapiens
aacctgtgggcctgttgcaatactt

SEQ ID NO: 4234 - DNA, 25 bp, Homo sapiens
tgggcctgttgcaatactttaaaaa

SEQ ID NO: 4235 - DNA, 25 bp, Homo sapiens
tccatttgcttgttttgtatagaca

SEQ ID NO: 4236 - DNA, 25 bp, Homo sapiens
ccatttgcttgttttgtatagacat

SEQ ID NO: 4237 - DNA, 25 bp, Homo sapiens
tccagagctgagatggcataggcct

SEQ ID NO: 4238 - DNA, 25 bp, Homo sapiens
cataggccttagcagtaacgggtag

SEQ ID NO: 4239 - DNA, 25 bp, Homo sapiens
agcagtaacgggtagcagcagatgt

SEQ ID NO: 4240 - DNA, 25 bp, Homo sapiens
atacagcagagaagctgtaggactg

SEQ ID NO: 4241 - DNA, 25 bp, Homo sapiens
taggactgtttgtgactggccctgt

SEQ ID NO: 4242 - DNA, 25 bp, Homo sapiens
tgtgactggccctgtcctggcatca

SEQ ID NO: 4243 - DNA, 25 bp, Homo sapiens
tgtcctggcatcagtagcatctgta

SEQ ID NO: 4244 - DNA, 25 bp, Homo sapiens
tcctggcatcagtagcatctgtaac

SEQ ID NO: 4245 - DNA, 25 bp, Homo sapiens
tggcatcagtagcatctgtaacagc

SEQ ID NO: 4246 - DNA, 25 bp, Homo sapiens
gcatcagtagcatctgtaacagcat

SEQ ID NO: 4247 - DNA, 25 bp, Homo sapiens
catcagtagcatctgtaacagcatt

SEQ ID NO: 4248 - DNA, 25 bp, Homo sapiens
tcagtagcatctgtaacagcattaa

SEQ ID NO: 4249 - DNA, 25 bp, Homo sapiens
gtagcatctgtaacagcattaactg

SEQ ID NO: 4250 - DNA, 25 bp, Homo sapiens
agcatctgtaacagcattaactgtc

SEQ ID NO: 4251 - DNA, 25 bp, Homo sapiens
gtaacagcattaactgtcttaaaga

SEQ ID NO: 4252 - DNA, 25 bp, Homo sapiens
taacagcattaactgtcttaaagag

SEQ ID NO: 4253 - DNA, 25 bp, Homo sapiens
ccaaaatgcatccaaaataagatgg

SEQ ID NO: 4254 - DNA, 25 bp, Homo sapiens
gaagtcagtacagcagaatggtaac

SEQ ID NO: 4255 - DNA, 25 bp, Homo sapiens
gtcagtacagcagaatggtaacaag

SEQ ID NO: 4256 - DNA, 25 bp, Homo sapiens
gtaacaagtgagcatctccctaatg

SEQ ID NO: 4257 - DNA, 25 bp, Homo sapiens
taacaagtgagcatctccctaatgg

SEQ ID NO: 4258 - DNA, 25 bp, Homo sapiens
acaagtgagcatctccctaatggga

SEQ ID NO: 4259 - DNA, 25 bp, Homo sapiens
caagtgagcatctccctaatgggaa

SEQ ID NO: 4260 - DNA, 25 bp, Homo sapiens
tgagcatctccctaatgggaatggg

SEQ ID NO: 4261 - DNA, 25 bp, Homo sapiens
agcatctccctaatgggaatgggac

SEQ ID NO: 4262 - DNA, 25 bp, Homo sapiens
gcatctccctaatgggaatgggaca

SEQ ID NO: 4263 - DNA, 25 bp, Homo sapiens
ctccctaatgggaatgggacattcc

SEQ ID NO: 4264 - DNA, 25 bp, Homo sapiens
tccctaatgggaatgggacattcct

SEQ ID NO: 4265 - DNA, 25 bp, Homo sapiens
ggaatgggacattcctggtagagct

SEQ ID NO: 4266 - DNA, 25 bp, Homo sapiens
aatgggacattcctggtagagctgg

SEQ ID NO: 4267 - DNA, 25 bp, Homo sapiens
gacattcctggtagagctgggagaa

SEQ ID NO: 4268 - DNA, 25 bp, Homo sapiens
acattcctggtagagctgggagaaa

SEQ ID NO: 4269 - DNA, 25 bp, Homo sapiens
agaagagacccaaatcattctgaag

SEQ ID NO: 4270 - DNA, 25 bp, Homo sapiens
acccaaatcattctgaaggctcaac

SEQ ID NO: 4271 - DNA, 25 bp, Homo sapiens
ggttatacctctcattacccacaca

SEQ ID NO: 4272 - DNA, 25 bp, Homo sapiens
tcattacccacacacgaaggaaagc

SEQ ID NO: 4273 - DNA, 25 bp, Homo sapiens
cccacacacgaaggaaagcaggacc

SEQ ID NO: 4274 - DNA, 25 bp, Homo sapiens
ccttcatcccagtgacctcagctaa

SEQ ID NO: 4275 - DNA, 25 bp, Homo sapiens
atcccagtgacctcagctaagactg

SEQ ID NO: 4276 - DNA, 25 bp, Homo sapiens
acctcagctaagactgggtcctttg

SEQ ID NO: 4277 - DNA, 25 bp, Homo sapiens
gctaagactgggtcctttggagtta

SEQ ID NO: 4278 - DNA, 25 bp, Homo sapiens
ctgggtcctttggagttactgcagt

SEQ ID NO: 4279 - DNA, 25 bp, Homo sapiens
tcctttggagttactgcagttactg

SEQ ID NO: 4280 - DNA, 25 bp, Homo sapiens
gttactgttggagattccaactcta

SEQ ID NO: 4281 - DNA, 25 bp, Homo sapiens
tggagattccaactctaatgtcaat

SEQ ID NO: 4282 - DNA, 25 bp, Homo sapiens
actctaatgtcaatcgttccttatc

SEQ ID NO: 4283 - DNA, 25 bp, Homo sapiens
atgtcaatcgttccttatcaggaga

SEQ ID NO: 4284 - DNA, 25 bp, Homo sapiens
atcgttccttatcaggagaccaaga

SEQ ID NO: 4285 - DNA, 25 bp, Homo sapiens
acattacaggcaggtgtctcatatg

SEQ ID NO: 4286 - DNA, 25 bp, Homo sapiens
acaggcaggtgtctcatatgtaaaa

SEQ ID NO: 4287 - DNA, 25 bp, Homo sapiens
ggcaggtgtctcatatgtaaaacat

SEQ ID NO: 4288 - DNA, 25 bp, Homo sapiens
aacatttacctgaatgttgtctgag

SEQ ID NO: 4289 - DNA, 25 bp, Homo sapiens
tttacctgaatgttgtctgaggact

SEQ ID NO: 4290 - DNA, 25 bp, Homo sapiens
acctgaatgttgtctgaggactgaa

SEQ ID NO: 4291 - DNA, 25 bp, Homo sapiens
tgttgtctgaggactgaactgtgga

SEQ ID NO: 4292 - DNA, 25 bp, Homo sapiens
tgtctgaggactgaactgtggactt

SEQ ID NO: 4293 - DNA, 25 bp, Homo sapiens
aggactgaactgtggactttactat

SEQ ID NO: 4294 - DNA, 25 bp, Homo sapiens
tgaactgtggactttactattcata

SEQ ID NO: 4295 - DNA, 25 bp, Homo sapiens
tgtggactttactattcataatgat

SEQ ID NO: 4296 - DNA, 25 bp, Homo sapiens
ggactttactattcataatgataaa

SEQ ID NO: 4297 - DNA, 25 bp, Homo sapiens
tatatctcatgtcatcacattacag

SEQ ID NO: 4298 - DNA, 25 bp, Homo sapiens
atctcatgtcatcacattacaggca

SEQ ID NO: 4299 - DNA, 25 bp, Homo sapiens
tcatgtcatcacattacaggcaggt

SEQ ID NO: 4300 - DNA, 25 bp, Homo sapiens
gtcatcacattacaggcaggtgtct

SEQ ID NO: 4301 - DNA, 25 bp, Homo sapiens
agtgttcacatcactaaactcatcg

SEQ ID NO: 4302 - DNA, 25 bp, Homo sapiens
gcgtttcttgatgggacatttagca

SEQ ID NO: 4303 - DNA, 25 bp, Homo sapiens
tttagcaaatacctctgccgctgtt

SEQ ID NO: 4304 - DNA, 25 bp, Homo sapiens
ctctgccgctgtttccatctgcgta

SEQ ID NO: 4305 - DNA, 25 bp, Homo sapiens
cgctgtttccatctgcgtagtaaca

SEQ ID NO: 4306 - DNA, 25 bp, Homo sapiens
gggcagtctgcacaaggcacatcga

SEQ ID NO: 4307 - DNA, 25 bp, Homo sapiens
taaactagcatccaccaaatgcaag

SEQ ID NO: 4308 - DNA, 25 bp, Homo sapiens
agcatccaccaaatgcaagaagaat

SEQ ID NO: 4309 - DNA, 25 bp, Homo sapiens
taaacatggattttcatctttctgc

SEQ ID NO: 4310 - DNA, 25 bp, Homo sapiens
gcactgaatttgtctcaggcaccgt

SEQ ID NO: 4311 - DNA, 25 bp, Homo sapiens
tctcaggcaccgtgcaaggctcttt

SEQ ID NO: 4312 - DNA, 25 bp, Homo sapiens
cttgtccatagtgtggataggacta

SEQ ID NO: 4313 - DNA, 25 bp, Homo sapiens
ggcagaactgattctccagccctgg

SEQ ID NO: 4314 - DNA, 25 bp, Homo sapiens
tctccagccctggtagcatttgctc

SEQ ID NO: 4315 - DNA, 25 bp, Homo sapiens
gtagcatttgctcagagcctacgct

SEQ ID NO: 4316 - DNA, 25 bp, Homo sapiens
cagagcctacgcttggtccagaaca

SEQ ID NO: 4317 - DNA, 25 bp, Homo sapiens
aatattcattttactcagaatagcc

SEQ ID NO: 4318 - DNA, 25 bp, Homo sapiens
cattttactcagaatagcctgtttt

SEQ ID NO: 4319 - DNA, 25 bp, Homo sapiens
ttgagcctttattggtaaattctgg

SEQ ID NO: 4320 - DNA, 25 bp, Homo sapiens
gctggactagtgtcctaaaaatggc

SEQ ID NO: 4321 - DNA, 25 bp, Homo sapiens
ctagtgtcctaaaaatggctaactg

SEQ ID NO: 4322 - DNA, 25 bp, Homo sapiens
gccatctgacagacggccactagtg

SEQ ID NO: 4323 - DNA, 25 bp, Homo sapiens
ttttatactgtacatgctatgctga

SEQ ID NO: 4324 - DNA, 25 bp, Homo sapiens
actgtacatgctatgctgaagacat

SEQ ID NO: 4325 - DNA, 25 bp, Homo sapiens
aactgtgtaaaccacataattttgt

SEQ ID NO: 4326 - DNA, 25 bp, Homo sapiens
tacatccaaggatgaggtgtgacct

SEQ ID NO: 4327 - DNA, 25 bp, Homo sapiens
gttttatatcaaatgccttcatgaa

SEQ ID NO: 4328 - DNA, 25 bp, Homo sapiens
tatcaaatgccttcatgaatctttc

SEQ ID NO: 4329 - DNA, 25 bp, Homo sapiens
tcatgaatctttcatacatatatat

SEQ ID NO: 4330 - DNA, 25 bp, Homo sapiens
acccaatacttttgtccaatgtggt

SEQ ID NO: 4331 - DNA, 25 bp, Homo sapiens
tacttttgtccaatgtggttggtca

SEQ ID NO: 4332 - DNA, 25 bp, Homo sapiens
tgtccaatgtggttggtcaaatcaa

SEQ ID NO: 4333 - DNA, 25 bp, Homo sapiens
cctggagcgctatgtagagacgcag

SEQ ID NO: 4334 - DNA, 25 bp, Homo sapiens
tcaccctgtgcaagtgcatgatcga

SEQ ID NO: 4335 - DNA, 25 bp, Homo sapiens
ccctgtgcaagtgcatgatcgacca

SEQ ID NO: 4336 - DNA, 25 bp, Homo sapiens
tgtgcaagtgcatgatcgaccaggc

SEQ ID NO: 4337 - DNA, 25 bp, Homo sapiens
agtgcatgatcgaccaggcacatca

SEQ ID NO: 4338 - DNA, 25 bp, Homo sapiens
gcatgatcgaccaggcacatcaaga

SEQ ID NO: 4339 - DNA, 25 bp, Homo sapiens
accaggcacatcaagaagaacggcc

SEQ ID NO: 4340 - DNA, 25 bp, Homo sapiens
aggcacatcaagaagaacggccaat

SEQ ID NO: 4341 - DNA, 25 bp, Homo sapiens
cacatcaagaagaacggccaatccg

SEQ ID NO: 4342 - DNA, 25 bp, Homo sapiens
caatccgacagattttgtacctcgg

SEQ ID NO: 4343 - DNA, 25 bp, Homo sapiens
tccgacagattttgtacctcgggga

SEQ ID NO: 4344 - DNA, 25 bp, Homo sapiens
gcaagccctggatgaaaacatggac

SEQ ID NO: 4345 - DNA, 25 bp, Homo sapiens
accagcacattgaccgctggctgct

SEQ ID NO: 4346 - DNA, 25 bp, Homo sapiens
atgctcggggatctgtcggacagcc

SEQ ID NO: 4347 - DNA, 25 bp, Homo sapiens
ggatctgtcggacagccagctaaag

SEQ ID NO: 4348 - DNA, 25 bp, Homo sapiens
tcatctgtagccaagaagagagcat

SEQ ID NO: 4349 - DNA, 25 bp, Homo sapiens
tgaactgcacgataaaggaactcag

SEQ ID NO: 4350 - DNA, 25 bp, Homo sapiens
aactcaggcgcctcttcttagttga

SEQ ID NO: 4351 - DNA, 25 bp, Homo sapiens
gcctcttcttagttgatgatttagt

SEQ ID NO: 4352 - DNA, 25 bp, Homo sapiens
gtgggtatttacctatgttggtgcc

SEQ ID NO: 4353 - DNA, 25 bp, Homo sapiens
cttcagtgttcctgttatttatgaa

SEQ ID NO: 4354 - DNA, 25 bp, Homo sapiens
cattatctaggacttgcaaataaga

SEQ ID NO: 4355 - DNA, 25 bp, Homo sapiens
tgctatggctaaaatccaagcaaaa

SEQ ID NO: 4356 - DNA, 25 bp, Homo sapiens
gaagaacgaaccttgacgttgcagt

SEQ ID NO: 4357 - DNA, 25 bp, Homo sapiens
cacagatcgttgttagatctttatt

SEQ ID NO: 4358 - DNA, 25 bp, Homo sapiens
atttttagccatgcactgttgtgag

SEQ ID NO: 4359 - DNA, 25 bp, Homo sapiens
aaattacctgtcttgactgccatgt

SEQ ID NO: 4360 - DNA, 25 bp, Homo sapiens
aagctgctatgtatggatttaaacc

SEQ ID NO: 4361 - DNA, 25 bp, Homo sapiens
agctgctatgtatggatttaaaccg

SEQ ID NO: 4362 - DNA, 25 bp, Homo sapiens
tatctttttcctatctgaggcactg

SEQ ID NO: 4363 - DNA, 25 bp, Homo sapiens
ctatctgaggcactggtggaataaa

SEQ ID NO: 4364 - DNA, 25 bp, Homo sapiens
tttactttgttgcagatagtcttgc

SEQ ID NO: 4365 - DNA, 25 bp, Homo sapiens
gcccaggagctacacaccttcgagg

SEQ ID NO: 4366 - DNA, 25 bp, Homo sapiens
ggagctacacaccttcgaggtgacc

SEQ ID NO: 4367 - DNA, 25 bp, Homo sapiens
aaacggtcgcccagatcaaggctca

SEQ ID NO: 4368 - DNA, 25 bp, Homo sapiens
gacgtgacacgcagcccacggtctg

SEQ ID NO: 4369 - DNA, 25 bp, Homo sapiens
gcattgccccggaagatcaagtcgt

SEQ ID NO: 4370 - DNA, 25 bp, Homo sapiens
aagtcgtgctcctggcaggcgcgcc

SEQ ID NO: 4371 - DNA, 25 bp, Homo sapiens
gcgcccctggaggatgaggccactc

SEQ ID NO: 4372 - DNA, 25 bp, Homo sapiens
cccctggaggatgaggccactctgg

SEQ ID NO: 4373 - DNA, 25 bp, Homo sapiens
gcagcccacggtctgtactgacgcg

SEQ ID NO: 4374 - DNA, 25 bp, Homo sapiens
gtggaggccctgactaccctggaag

SEQ ID NO: 4375 - DNA, 25 bp, Homo sapiens
caggccgcatgcttggaggtaaagt

SEQ ID NO: 4376 - DNA, 25 bp, Homo sapiens
tgagaggtcagactcctaaggtggc

SEQ ID NO: 4377 - DNA, 25 bp, Homo sapiens
gtcagactcctaaggtggccaaaca

SEQ ID NO: 4378 - DNA, 25 bp, Homo sapiens
actcttaagtcttttgtaattctgg

SEQ ID NO: 4379 - DNA, 25 bp, Homo sapiens
ctttctcgactccatcttcgcggta

SEQ ID NO: 4380 - DNA, 25 bp, Homo sapiens
atcttcgcggtagctgggaccgccg

SEQ ID NO: 4381 - DNA, 25 bp, Homo sapiens
catgagcgactgtgcctctccagtc

SEQ ID NO: 4382 - DNA, 25 bp, Homo sapiens
actgtgcctctccagtccctgtgtt

SEQ ID NO: 4383 - DNA, 25 bp, Homo sapiens
ttttggaggcactttcactgtgttg

SEQ ID NO: 4384 - DNA, 25 bp, Homo sapiens
tttggaggcactttcactgtgttgc

SEQ ID NO: 4385 - DNA, 25 bp, Homo sapiens
ggaggcactttcactgtgttgccca

SEQ ID NO: 4386 - DNA, 25 bp, Homo sapiens
gttgcccaggcctgtctgttggcct

SEQ ID NO: 4387 - DNA, 25 bp, Homo sapiens
taattttggactttgctcactaaag

SEQ ID NO: 4388 - DNA, 25 bp, Homo sapiens
ttttggactttgctcactaaagttt

SEQ ID NO: 4389 - DNA, 25 bp, Homo sapiens
tttggactttgctcactaaagtttg

SEQ ID NO: 4390 - DNA, 25 bp, Homo sapiens
ttggactttgctcactaaagtttga

SEQ ID NO: 4391 - DNA, 25 bp, Homo sapiens
gactttgctcactaaagtttgaatg

SEQ ID NO: 4392 - DNA, 25 bp, Homo sapiens
gtatacagtctggatgcagtggtgc

SEQ ID NO: 4393 - DNA, 25 bp, Homo sapiens
tacagtctggatgcagtggtgcatg

SEQ ID NO: 4394 - DNA, 25 bp, Homo sapiens
acagtctggatgcagtggtgcatgc

SEQ ID NO: 4395 - DNA, 25 bp, Homo sapiens
agccagacatgatggcatgcaccta

SEQ ID NO: 4396 - DNA, 25 bp, Homo sapiens
agacatgatggcatgcacctataat

SEQ ID NO: 4397 - DNA, 25 bp, Homo sapiens
tactgtgacatactcgagtataaag

SEQ ID NO: 4398 - DNA, 25 bp, Homo sapiens
tgacatactcgagtataaagacatg

SEQ ID NO: 4399 - DNA, 25 bp, Homo sapiens
gacatactcgagtataaagacatgt

SEQ ID NO: 4400 - DNA, 25 bp, Homo sapiens
ggggagtctcacagtgcctttggaa

SEQ ID NO: 4401 - DNA, 25 bp, Homo sapiens
cagtgcctttggaagggcccgaact

SEQ ID NO: 4402 - DNA, 25 bp, Homo sapiens
atgtaggatgggttcaactgcacaa

SEQ ID NO: 4403 - DNA, 25 bp, Homo sapiens
gatgggttcaactgcacaaaaggaa

SEQ ID NO: 4404 - DNA, 25 bp, Homo sapiens
caactgcacaaaaggaaaagatttt

SEQ ID NO: 4405 - DNA, 25 bp, Homo sapiens
taaagtgaagcaaccgccttagtgc

SEQ ID NO: 4406 - DNA, 25 bp, Homo sapiens
cgccttagtgctgaaatatgtagta

SEQ ID NO: 4407 - DNA, 25 bp, Homo sapiens
ttgtacgtaggtacagttggagcac

SEQ ID NO: 4408 - DNA, 25 bp, Homo sapiens
tacagttggagcactatatgtactc

SEQ ID NO: 4409 - DNA, 25 bp, Homo sapiens
tgtactctctggactactttggaca

SEQ ID NO: 4410 - DNA, 25 bp, Homo sapiens
ctctggactactttggacagaagta

SEQ ID NO: 4411 - DNA, 25 bp, Homo sapiens
ctggactactttggacagaagtagg

SEQ ID NO: 4412 - DNA, 25 bp, Homo sapiens
atattttggggaatcagctcactac

SEQ ID NO: 4413 - DNA, 25 bp, Homo sapiens
aactcacagagatctactcagacag

SEQ ID NO: 4414 - DNA, 25 bp, Homo sapiens
tcacagagatctactcagacaggac

SEQ ID NO: 4415 - DNA, 25 bp, Homo sapiens
aggaccttcgcacctttgccagagt

SEQ ID NO: 4416 - DNA, 25 bp, Homo sapiens
accttcgcacctttgccagagtttg

SEQ ID NO: 4417 - DNA, 25 bp, Homo sapiens
gcacctttgccagagtttgagcagg

SEQ ID NO: 4418 - DNA, 25 bp, Homo sapiens
ggtaactgaggactctgatgaagac

SEQ ID NO: 4419 - DNA, 25 bp, Homo sapiens
gtaactgaggactctgatgaagact

SEQ ID NO: 4420 - DNA, 25 bp, Homo sapiens
gaagactttatacagccccgcagaa

SEQ ID NO: 4421 - DNA, 25 bp, Homo sapiens
aaacgcctaaagtcagatgagagac

SEQ ID NO: 4422 - DNA, 25 bp, Homo sapiens
acgcctaaagtcagatgagagacca

SEQ ID NO: 4423 - DNA, 25 bp, Homo sapiens
cgcctaaagtcagatgagagaccag

SEQ ID NO: 4424 - DNA, 25 bp, Homo sapiens
aacagtcagggctcagcagccttgt

SEQ ID NO: 4425 - DNA, 25 bp, Homo sapiens
ctcatgcacaggtcggcaaggattg

SEQ ID NO: 4426 - DNA, 25 bp, Homo sapiens
aaatgaagactggtgtgctgtctgc

SEQ ID NO: 4427 - DNA, 25 bp, Homo sapiens
tccaaggtaccagtgaaataattga

SEQ ID NO: 4428 - DNA, 25 bp, Homo sapiens
aacagggagcctgttattcttttgg

SEQ ID NO: 4429 - DNA, 25 bp, Homo sapiens
tgaaagacctttcaaacccctcgag

SEQ ID NO: 4430 - DNA, 25 bp, Homo sapiens
ggccagcttctacagtacgtccact

SEQ ID NO: 4431 - DNA, 25 bp, Homo sapiens
cctttctgtctctgcctgaatagga

SEQ ID NO: 4432 - DNA, 25 bp, Homo sapiens
gctcagttggtgctgctttcttgtt

SEQ ID NO: 4433 - DNA, 25 bp, Homo sapiens
gctttcttgttgctgcatctcccct

SEQ ID NO: 4434 - DNA, 25 bp, Homo sapiens
cctctgttcgcgactagttggctct

SEQ ID NO: 4435 - DNA, 25 bp, Homo sapiens
ctctgttcgcgactagttggctctg

SEQ ID NO: 4436 - DNA, 25 bp, Homo sapiens
gactagttggctctgagatactaat

SEQ ID NO: 4437 - DNA, 25 bp, Homo sapiens
ctagttggctctgagatactaatag

SEQ ID NO: 4438 - DNA, 25 bp, Homo sapiens
gatactaataggtgtgtgaggctcc

SEQ ID NO: 4439 - DNA, 25 bp, Homo sapiens
tgaggctccggatgtttctggaatt

SEQ ID NO: 4440 - DNA, 25 bp, Homo sapiens
ctccggatgtttctggaattgatat

SEQ ID NO: 4441 - DNA, 25 bp, Homo sapiens
atacaatgaccacatcctgaaaagg

SEQ ID NO: 4442 - DNA, 25 bp, Homo sapiens
cacatcctgaaaagggtgttgctaa

SEQ ID NO: 4443 - DNA, 25 bp, Homo sapiens
gtgttgctaagctgtaaccgatatg

SEQ ID NO: 4444 - DNA, 25 bp, Homo sapiens
ttgctaagctgtaaccgatatgcac

SEQ ID NO: 4445 - DNA, 25 bp, Homo sapiens
cgacctctcagatattagggaggtt

SEQ ID NO: 4446 - DNA, 25 bp, Homo sapiens
aaggaatacgctgaatccataggtg

SEQ ID NO: 4447 - DNA, 25 bp, Homo sapiens
ctgaatccataggtgccatcgtggt

SEQ ID NO: 4448 - DNA, 25 bp, Homo sapiens
aggtgccatcgtggttgagacaagt

SEQ ID NO: 4449 - DNA, 25 bp, Homo sapiens
tatcgaagagctctttcaaggaatc

SEQ ID NO: 4450 - DNA, 25 bp, Homo sapiens
ctctttcaaggaatcagccgccaga

SEQ ID NO: 4451 - DNA, 25 bp, Homo sapiens
tggacccccatgaaaatggaaacaa

SEQ ID NO: 4452 - DNA, 25 bp, Homo sapiens
acccccatgaaaatggaaacaatgg

SEQ ID NO: 4453 - DNA, 25 bp, Homo sapiens
cagccgccggtgctgttgacccaag

SEQ ID NO: 4454 - DNA, 25 bp, Homo sapiens
ccgccggtgctgttgacccaagggc

SEQ ID NO: 4455 - DNA, 25 bp, Homo sapiens
ccacatcctgtgcactgctgaagga

SEQ ID NO: 4456 - DNA, 25 bp, Homo sapiens
gtgcactgctgaaggaccctacgct

SEQ ID NO: 4457 - DNA, 25 bp, Homo sapiens
ggcacctcactttgagaagagtgag

SEQ ID NO: 4458 - DNA, 25 bp, Homo sapiens
gagcacactggctttgcatcctgga

SEQ ID NO: 4459 - DNA, 25 bp, Homo sapiens
gcacactggctttgcatcctggaag

SEQ ID NO: 4460 - DNA, 25 bp, Homo sapiens
atggcctttagtgtatgaaatgcac

SEQ ID NO: 4461 - DNA, 25 bp, Homo sapiens
agatcacaaagctcaaggaatttaa

SEQ ID NO: 4462 - DNA, 25 bp, Homo sapiens
gatcacaaagctcaaggaatttaat

SEQ ID NO: 4463 - DNA, 25 bp, Homo sapiens
actgattagcccattccagaagaaa

SEQ ID NO: 4464 - DNA, 25 bp, Homo sapiens
ctgattagcccattccagaagaaaa

SEQ ID NO: 4465 - DNA, 25 bp, Homo sapiens
agaacatccaaacctcaaggctcag

SEQ ID NO: 4466 - DNA, 25 bp, Homo sapiens
gaacatccaaacctcaaggctcagg

SEQ ID NO: 4467 - DNA, 25 bp, Homo sapiens
cctcaaggctcaggatcccatagac

SEQ ID NO: 4468 - DNA, 25 bp, Homo sapiens
gagcccacctttttgataaacttag

SEQ ID NO: 4469 - DNA, 25 bp, Homo sapiens
agtttgtgacacataagcttcccaa

SEQ ID NO: 4470 - DNA, 25 bp, Homo sapiens
gtttgtgacacataagcttcccaaa

SEQ ID NO: 4471 - DNA, 25 bp, Homo sapiens
actacatatttgtatgcaagacaag

SEQ ID NO: 4472 - DNA, 25 bp, Homo sapiens
tatgcaagacaagcatccagttttt

SEQ ID NO: 4473 - DNA, 25 bp, Homo sapiens
aatgcagtgacagtgtggaatgacc

SEQ ID NO: 4474 - DNA, 25 bp, Homo sapiens
ggaatgaccactcagccattataaa

SEQ ID NO: 4475 - DNA, 25 bp, Homo sapiens
gtacaagacacttgtgaaaatcagt

SEQ ID NO: 4476 - DNA, 25 bp, Homo sapiens
acattatagtcattgtcacaaatgg

SEQ ID NO: 4477 - DNA, 25 bp, Homo sapiens
acagaccaaggagaactggagaaag

SEQ ID NO: 4478 - DNA, 25 bp, Homo sapiens
cagttcgtggttgcattgtggatgc

SEQ ID NO: 4479 - DNA, 25 bp, Homo sapiens
gagcgttctcaacttggttattgta

SEQ ID NO: 4480 - DNA, 25 bp, Homo sapiens
tggactgactgatactacagtgcct

SEQ ID NO: 4481 - DNA, 25 bp, Homo sapiens
cctgggccccaaaagagctagcaga

SEQ ID NO: 4482 - DNA, 25 bp, Homo sapiens
ccccaaaagagctagcagaatccgc

SEQ ID NO: 4483 - DNA, 25 bp, Homo sapiens
aagagctagcagaatccgcaaactt

SEQ ID NO: 4484 - DNA, 25 bp, Homo sapiens
ttcaatctctctaaagaagatgatg

SEQ ID NO: 4485 - DNA, 25 bp, Homo sapiens
gaaacctaggaccaaagcacccaag

SEQ ID NO: 4486 - DNA, 25 bp, Homo sapiens
caaacggcggcgtattgctctgaag

SEQ ID NO: 4487 - DNA, 25 bp, Homo sapiens
aacggcggcgtattgctctgaagaa

SEQ ID NO: 4488 - DNA, 25 bp, Homo sapiens
acggcggcgtattgctctgaagaag

SEQ ID NO: 4489 - DNA, 25 bp, Homo sapiens
gcggcgtattgctctgaagaagcag

SEQ ID NO: 4490 - DNA, 25 bp, Homo sapiens
gcgtattgctctgaagaagcagcgt

SEQ ID NO: 4491 - DNA, 25 bp, Homo sapiens
ttgctctgaagaagcagcgtaccaa

SEQ ID NO: 4492 - DNA, 25 bp, Homo sapiens
tgctctgaagaagcagcgtaccaag

SEQ ID NO: 4493 - DNA, 25 bp, Homo sapiens
accccaagtccctgaagtctggaga

SEQ ID NO: 4494 - DNA, 25 bp, Homo sapiens
ccccaagtccctgaagtctggagac

SEQ ID NO: 4495 - DNA, 25 bp, Homo sapiens
ccaagtccctgaagtctggagacgc

SEQ ID NO: 4496 - DNA, 25 bp, Homo sapiens
gaaagcccatgtgtgtggagagctt

SEQ ID NO: 4497 - DNA, 25 bp, Homo sapiens
aaagcccatgtgtgtggagagcttc

SEQ ID NO: 4498 - DNA, 25 bp, Homo sapiens
aagcccatgtgtgtggagagcttct

SEQ ID NO: 4499 - DNA, 25 bp, Homo sapiens
agcccatgtgtgtggagagcttctc

SEQ ID NO: 4500 - DNA, 25 bp, Homo sapiens
gcccatgtgtgtggagagcttctcc

SEQ ID NO: 4501 - DNA, 25 bp, Homo sapiens
cccatgtgtgtggagagcttctccc

SEQ ID NO: 4502 - DNA, 25 bp, Homo sapiens
ccatgtgtgtggagagcttctccca

SEQ ID NO: 4503 - DNA, 25 bp, Homo sapiens
cggcgccggcaaggtcaccaagtcg

SEQ ID NO: 4504 - DNA, 25 bp, Homo sapiens
gcgccggcaaggtcaccaagtcggc

SEQ ID NO: 4505 - DNA, 25 bp, Homo sapiens
cctggcgatggtctcagcagcccag

SEQ ID NO: 4506 - DNA, 25 bp, Homo sapiens
cgatggtctcagcagcccagccggg

SEQ ID NO: 4507 - DNA, 25 bp, Homo sapiens
ccccagagcctgaggctgagggctc

SEQ ID NO: 4508 - DNA, 25 bp, Homo sapiens
aggatgcggcttgatacctggacat

SEQ ID NO: 4509 - DNA, 25 bp, Homo sapiens
gatgcggcttgatacctggacatta

SEQ ID NO: 4510 - DNA, 25 bp, Homo sapiens
gcggcttgatacctggacattaaag

SEQ ID NO: 4511 - DNA, 25 bp, Homo sapiens
cggcttgatacctggacattaaagt

SEQ ID NO: 4512 - DNA, 25 bp, Homo sapiens
ttgatacctggacattaaagtgacg

SEQ ID NO: 4513 - DNA, 25 bp, Homo sapiens
tgatacctggacattaaagtgacga

SEQ ID NO: 4514 - DNA, 25 bp, Homo sapiens
ctcagcctccctgatgaagagttga

SEQ ID NO: 4515 - DNA, 25 bp, Homo sapiens
agcctccctgatgaagagttgacaa

SEQ ID NO: 4516 - DNA, 25 bp, Homo sapiens
cccacttcctttcttgtgcttcgtg

SEQ ID NO: 4517 - DNA, 25 bp, Homo sapiens
tcttgtgcttcgtgtcctgttgacg

SEQ ID NO: 4518 - DNA, 25 bp, Homo sapiens
cttgtgcttcgtgtcctgttgacgg

SEQ ID NO: 4519 - DNA, 25 bp, Homo sapiens
tgcttcgtgtcctgttgacggttac

SEQ ID NO: 4520 - DNA, 25 bp, Homo sapiens
ttcgtgtcctgttgacggttacatt

SEQ ID NO: 4521 - DNA, 25 bp, Homo sapiens
catacaaataacacgagaagatttg

SEQ ID NO: 4522 - DNA, 25 bp, Homo sapiens
aagtgtagattctcttacccagtcc

SEQ ID NO: 4523 - DNA, 25 bp, Homo sapiens
gtgtagattctcttacccagtcctc

SEQ ID NO: 4524 - DNA, 25 bp, Homo sapiens
tcagtttcttctgaaaaccagatgg

SEQ ID NO: 4525 - DNA, 25 bp, Homo sapiens
cttctgaaaaccagatggagagatt

SEQ ID NO: 4526 - DNA, 25 bp, Homo sapiens
aggactgaaaaacctcaaggccatt

SEQ ID NO: 4527 - DNA, 25 bp, Homo sapiens
tgaaaaacctcaaggccattgatgt

SEQ ID NO: 4528 - DNA, 25 bp, Homo sapiens
aacctcaaggccattgatgtaaagc

SEQ ID NO: 4529 - DNA, 25 bp, Homo sapiens
tcaaggccattgatgtaaagctact

SEQ ID NO: 4530 - DNA, 25 bp, Homo sapiens
gtgtgtacaaagactgcagggtttc

SEQ ID NO: 4531 - DNA, 25 bp, Homo sapiens
aagactgcagggtttccattccagc

SEQ ID NO: 4532 - DNA, 25 bp, Homo sapiens
gggtttccattccagctccagcttt

SEQ ID NO: 4533 - DNA, 25 bp, Homo sapiens
aactcaaaatttagcgtatttctgg

SEQ ID NO: 4534 - DNA, 25 bp, Homo sapiens
agaagaaaccccagtgggtcatgtg

SEQ ID NO: 4535 - DNA, 25 bp, Homo sapiens
gaagaaaccccagtgggtcatgtgg

SEQ ID NO: 4536 - DNA, 25 bp, Homo sapiens
accccagtgggtcatgtggttacca

SEQ ID NO: 4537 - DNA, 25 bp, Homo sapiens
acagggtgctcagctcttccaccgt

SEQ ID NO: 4538 - DNA, 25 bp, Homo sapiens
ccgtcattttgaattgttcacatgg

SEQ ID NO: 4539 - DNA, 25 bp, Homo sapiens
aatgatcagattgaccttgattgac

SEQ ID NO: 4540 - DNA, 25 bp, Homo sapiens
tcagattgaccttgattgactgtca

SEQ ID NO: 4541 - DNA, 25 bp, Homo sapiens
tctactcctgcaatgaaccctgttg

SEQ ID NO: 4542 - DNA, 25 bp, Homo sapiens
gacaccggatttagctcttgtcggc

SEQ ID NO: 4543 - DNA, 25 bp, Homo sapiens
atttagctcttgtcggccttcgtgg

SEQ ID NO: 4544 - DNA, 25 bp, Homo sapiens
taatatgagctactgcatgtaattc

SEQ ID NO: 4545 - DNA, 25 bp, Homo sapiens
aatatgagctactgcatgtaattct

SEQ ID NO: 4546 - DNA, 25 bp, Homo sapiens
tatgagctactgcatgtaattctta

SEQ ID NO: 4547 - DNA, 25 bp, Homo sapiens
agaatctgtactgcaagtaaaacct

SEQ ID NO: 4548 - DNA, 25 bp, Homo sapiens
ttgggtctgcattaaacgctgtagt

SEQ ID NO: 4549 - DNA, 25 bp, Homo sapiens
taaacgctgtagtccatgttcatgc

SEQ ID NO: 4550 - DNA, 25 bp, Homo sapiens
ctgtagtccatgttcatgccaaaaa

SEQ ID NO: 4551 - DNA, 25 bp, Homo sapiens
tgtagtccatgttcatgccaaaaaa

SEQ ID NO: 4552 - DNA, 25 bp, Homo sapiens
cactttatccacacaggaaagccag

SEQ ID NO: 4553 - DNA, 25 bp, Homo sapiens
ccccaagtgacctatacctgtgttt

SEQ ID NO: 4554 - DNA, 25 bp, Homo sapiens
aagtgacctatacctgtgtttcttg

SEQ ID NO: 4555 - DNA, 25 bp, Homo sapiens
tgcaaatgtagtatggcctgtgtca

SEQ ID NO: 4556 - DNA, 25 bp, Homo sapiens
tatggcctgtgtcactcagcagtgg

SEQ ID NO: 4557 - DNA, 25 bp, Homo sapiens
ctgtgtcactcagcagtgggacagc

SEQ ID NO: 4558 - DNA, 25 bp, Homo sapiens
ccagcgagggcgtgtctagcttgat

SEQ ID NO: 4559 - DNA, 25 bp, Homo sapiens
gcgtgtctagcttgatgttggatct

SEQ ID NO: 4560 - DNA, 25 bp, Homo sapiens
ctagcttgatgttggatctcaagag

SEQ ID NO: 4561 - DNA, 25 bp, Homo sapiens
tgatgttggatctcaagagccctgt

SEQ ID NO: 4562 - DNA, 25 bp, Homo sapiens
gccctgtcagtagagtagaagtctc

SEQ ID NO: 4563 - DNA, 25 bp, Homo sapiens
gagtagaagtctcttccagtttgct

SEQ ID NO: 4564 - DNA, 25 bp, Homo sapiens
ggttccccatgcagaggaacttggt

SEQ ID NO: 4565 - DNA, 25 bp, Homo sapiens
ccaggatatgaccaccttactcagc

SEQ ID NO: 4566 - DNA, 25 bp, Homo sapiens
aacaggaactggagggtctgtgcct

SEQ ID NO: 4567 - DNA, 25 bp, Homo sapiens
agggtctgtgccttgttgagctgta

SEQ ID NO: 4568 - DNA, 25 bp, Homo sapiens
gtctgtgccttgttgagctgtacct

SEQ ID NO: 4569 - DNA, 25 bp, Homo sapiens
ggagttgcagatcagcttgaagaac

SEQ ID NO: 4570 - DNA, 25 bp, Homo sapiens
gagttgcagatcagcttgaagaact

SEQ ID NO: 4571 - DNA, 25 bp, Homo sapiens
ttgcagatcagcttgaagaactatg

SEQ ID NO: 4572 - DNA, 25 bp, Homo sapiens
agatcagcttgaagaactatgatcc

SEQ ID NO: 4573 - DNA, 25 bp, Homo sapiens
ctatgatccccagaaggacaagcgc

SEQ ID NO: 4574 - DNA, 25 bp, Homo sapiens
tatgatccccagaaggacaagcgct

SEQ ID NO: 4575 - DNA, 25 bp, Homo sapiens
tccccagaaggacaagcgcttctcg

SEQ ID NO: 4576 - DNA, 25 bp, Homo sapiens
aaggacaagcgcttctcgggcaccg

SEQ ID NO: 4577 - DNA, 25 bp, Homo sapiens
gacaagcgcttctcgggcaccgtca

SEQ ID NO: 4578 - DNA, 25 bp, Homo sapiens
cgcttctcgggcaccgtcaggctta

SEQ ID NO: 4579 - DNA, 25 bp, Homo sapiens
tcgggcaccgtcaggcttaagtcca

SEQ ID NO: 4580 - DNA, 25 bp, Homo sapiens
ccgccctaagttctctgtgtgtgtc

SEQ ID NO: 4581 - DNA, 25 bp, Homo sapiens
ttctctgtgtgtgtcctgggggacc

SEQ ID NO: 4582 - DNA, 25 bp, Homo sapiens
tctctgtgtgtgtcctgggggacca

SEQ ID NO: 4583 - DNA, 25 bp, Homo sapiens
tgtcctgggggaccagcagcactgt

SEQ ID NO: 4584 - DNA, 25 bp, Homo sapiens
agcgccgcaagttcctggagacggt

SEQ ID NO: 4585 - DNA, 25 bp, Homo sapiens
gtatacaccatgagcaaagctcacc

SEQ ID NO: 4586 - DNA, 25 bp, Homo sapiens
ttaaatggtggcagacatgtccaag

SEQ ID NO: 4587 - DNA, 25 bp, Homo sapiens
gtggcagacatgtccaaggaatatt

SEQ ID NO: 4588 - DNA, 25 bp, Homo sapiens
tgcggggatttgatccctttatgaa

SEQ ID NO: 4589 - DNA, 25 bp, Homo sapiens
gatttgatccctttatgaaccttgt

SEQ ID NO: 4590 - DNA, 25 bp, Homo sapiens
tggagatggcgactagtggacaaca

SEQ ID NO: 4591 - DNA, 25 bp, Homo sapiens
agatggcgactagtggacaacagaa

SEQ ID NO: 4592 - DNA, 25 bp, Homo sapiens
tggcgactagtggacaacagaacaa

SEQ ID NO: 4593 - DNA, 25 bp, Homo sapiens
aatagtatcatcatgttagaagcct

SEQ ID NO: 4594 - DNA, 25 bp, Homo sapiens
tcatcatgttagaagccttggaacg

SEQ ID NO: 4595 - DNA, 25 bp, Homo sapiens
catcatgttagaagccttggaacga

SEQ ID NO: 4596 - DNA, 25 bp, Homo sapiens
tggctgttcagcagagaaacccatg

SEQ ID NO: 4597 - DNA, 25 bp, Homo sapiens
ttcagcagagaaacccatgtcctct

SEQ ID NO: 4598 - DNA, 25 bp, Homo sapiens
gtcctctctccatagggcctgtttt

SEQ ID NO: 4599 - DNA, 25 bp, Homo sapiens
catagggcctgttttactatgatgt

SEQ ID NO: 4600 - DNA, 25 bp, Homo sapiens
tttctaacatgaattttcctggttg

SEQ ID NO: 4601 - DNA, 25 bp, Homo sapiens
tctgaagctagacatgtgctttgaa

SEQ ID NO: 4602 - DNA, 25 bp, Homo sapiens
atgattatcatcctaatatcatggg

SEQ ID NO: 4603 - DNA, 25 bp, Homo sapiens
ctctatcagggaagttagctttcag

SEQ ID NO: 4604 - DNA, 25 bp, Homo sapiens
tccactggcgagtctgaatggaagg

SEQ ID NO: 4605 - DNA, 25 bp, Homo sapiens
ctggcgagtctgaatggaaggatac

SEQ ID NO: 4606 - DNA, 25 bp, Homo sapiens
cactcaacacagattccttggactg

SEQ ID NO: 4607 - DNA, 25 bp, Homo sapiens
aatggatttccttgccgaccgaggg

SEQ ID NO: 4608 - DNA, 25 bp, Homo sapiens
ggtggacaacacttttgcagatgag

SEQ ID NO: 4609 - DNA, 25 bp, Homo sapiens
acacttttgcagatgagctggtgga

SEQ ID NO: 4610 - DNA, 25 bp, Homo sapiens
agcaccaggagtacattacttttct

SEQ ID NO: 4611 - DNA, 25 bp, Homo sapiens
acttttcttgaagacctcaagagtt

SEQ ID NO: 4612 - DNA, 25 bp, Homo sapiens
ctcaagagttttgtcaagagccagt

SEQ ID NO: 4613 - DNA, 25 bp, Homo sapiens
agagccagtagagcagacagatgct

SEQ ID NO: 4614 - DNA, 25 bp, Homo sapiens
agtgaacaaatcctactctgaagct

SEQ ID NO: 4615 - DNA, 25 bp, Homo sapiens
gtgaacaaatcctactctgaagcta

SEQ ID NO: 4616 - DNA, 25 bp, Homo sapiens
ctactctgaagctagacatgtgctt

SEQ ID NO: 4617 - DNA, 25 bp, Homo sapiens
catgaatcacatagagcagtggagt

SEQ ID NO: 4618 - DNA, 25 bp, Homo sapiens
aaacttttcaaagactagtgtctga

SEQ ID NO: 4619 - DNA, 25 bp, Homo sapiens
ccatcatgttttatagtcattgttg

SEQ ID NO: 4620 - DNA, 25 bp, Homo sapiens
agtcattgttgcttccattgttagt

SEQ ID NO: 4621 - DNA, 25 bp, Homo sapiens
taaattcattcgtatcttgttggct

SEQ ID NO: 4622 - DNA, 25 bp, Homo sapiens
aaattcattcgtatcttgttggctg

SEQ ID NO: 4623 - DNA, 25 bp, Homo sapiens
attcattcgtatcttgttggctgcc

SEQ ID NO: 4624 - DNA, 25 bp, Homo sapiens
tcattcgtatcttgttggctgccta

SEQ ID NO: 4625 - DNA, 25 bp, Homo sapiens
cattcgtatcttgttggctgcctat

SEQ ID NO: 4626 - DNA, 25 bp, Homo sapiens
ttcgtatcttgttggctgcctatga

SEQ ID NO: 4627 - DNA, 25 bp, Homo sapiens
gattcagtagtcattgtatgcatct

SEQ ID NO: 4628 - DNA, 25 bp, Homo sapiens
attcagtagtcattgtatgcatctt

SEQ ID NO: 4629 - DNA, 25 bp, Homo sapiens
tcagtagtcattgtatgcatcttta

SEQ ID NO: 4630 - DNA, 25 bp, Homo sapiens
tagtcattgtatgcatctttaagtc

SEQ ID NO: 4631 - DNA, 25 bp, Homo sapiens
gtcattgtatgcatctttaagtcaa

SEQ ID NO: 4632 - DNA, 25 bp, Homo sapiens
ctgtttcctcttgtagtgctgatta

SEQ ID NO: 4633 - DNA, 25 bp, Homo sapiens
gcctccaaagtattgtacaaataag

SEQ ID NO: 4634 - DNA, 25 bp, Homo sapiens
tgtgcagtatctgtgaactgaattc

SEQ ID NO: 4635 - DNA, 25 bp, Homo sapiens
tgcagtatctgtgaactgaattcac

SEQ ID NO: 4636 - DNA, 25 bp, Homo sapiens
ctgtgaactgaattcaccacagact

SEQ ID NO: 4637 - DNA, 25 bp, Homo sapiens
gaactgaattcaccacagactttag

SEQ ID NO: 4638 - DNA, 25 bp, Homo sapiens
tcaccacagactttagctttctgag

SEQ ID NO: 4639 - DNA, 25 bp, Homo sapiens
actttagctttctgagcaagaggat

SEQ ID NO: 4640 - DNA, 25 bp, Homo sapiens
ctttagctttctgagcaagaggatt

SEQ ID NO: 4641 - DNA, 25 bp, Homo sapiens
agctttctgagcaagaggattttgc

SEQ ID NO: 4642 - DNA, 25 bp, Homo sapiens
ctttctgagcaagaggattttgcgt

SEQ ID NO: 4643 - DNA, 25 bp, Homo sapiens
ttctgagcaagaggattttgcgtca

SEQ ID NO: 4644 - DNA, 25 bp, Homo sapiens
ttttgcgtcagagaaatgtctgtcc

SEQ ID NO: 4645 - DNA, 25 bp, Homo sapiens
ttgagatttttatgcctgtgacttc

SEQ ID NO: 4646 - DNA, 25 bp, Homo sapiens
gatttttatgcctgtgacttccttg

SEQ ID NO: 4647 - DNA, 25 bp, Homo sapiens
tttttatgcctgtgacttccttgga

SEQ ID NO: 4648 - DNA, 25 bp, Homo sapiens
gcctgtgacttccttggaaatcaaa

SEQ ID NO: 4649 - DNA, 25 bp, Homo sapiens
caccttccctttcaacgaggatgag

SEQ ID NO: 4650 - DNA, 25 bp, Homo sapiens
gaagatgcgcaaacgctacagcgtg

SEQ ID NO: 4651 - DNA, 25 bp, Homo sapiens
cagacgtggctggacctccgagagc

SEQ ID NO: 4652 - DNA, 25 bp, Homo sapiens
gagagcgatacatcacgcatgagag

SEQ ID NO: 4653 - DNA, 25 bp, Homo sapiens
cacgcatgagagtgacgacgcgcgc

SEQ ID NO: 4654 - DNA, 25 bp, Homo sapiens
tctgggctgcccacggacagggatc

SEQ ID NO: 4655 - DNA, 25 bp, Homo sapiens
agcgcatcagtgttctctgaggtcc

SEQ ID NO: 4656 - DNA, 25 bp, Homo sapiens
gcatcagtgttctctgaggtcctgt

SEQ ID NO: 4657 - DNA, 25 bp, Homo sapiens
gttctctgaggtcctgtgccctcgt

SEQ ID NO: 4658 - DNA, 25 bp, Homo sapiens
ttctctgaggtcctgtgccctcgtc

SEQ ID NO: 4659 - DNA, 25 bp, Homo sapiens
tctgaggtcctgtgccctcgtccag

SEQ ID NO: 4660 - DNA, 25 bp, Homo sapiens
cctccacagcggttcttcacaggat

SEQ ID NO: 4661 - DNA, 25 bp, Homo sapiens
ctccacagcggttcttcacaggatc

SEQ ID NO: 4662 - DNA, 25 bp, Homo sapiens
cacagcggttcttcacaggatccca

SEQ ID NO: 4663 - DNA, 25 bp, Homo sapiens
ggttcttcacaggatcccagcaatg

SEQ ID NO: 4664 - DNA, 25 bp, Homo sapiens
tcacaggatcccagcaatgaactgt

SEQ ID NO: 4665 - DNA, 25 bp, Homo sapiens
tcccaggtgagaattcaggcaaacg

SEQ ID NO: 4666 - DNA, 25 bp, Homo sapiens
agaattcaggcaaacgtccacaaag

SEQ ID NO: 4667 - DNA, 25 bp, Homo sapiens
gaattcaggcaaacgtccacaaagg

SEQ ID NO: 4668 - DNA, 25 bp, Homo sapiens
caggcaaacgtccacaaaggtcaca

SEQ ID NO: 4669 - DNA, 25 bp, Homo sapiens
cacaaaggtcacaggcagcgtacat

SEQ ID NO: 4670 - DNA, 25 bp, Homo sapiens
aaggtcacaggcagcgtacatacgg

SEQ ID NO: 4671 - DNA, 25 bp, Homo sapiens
gtacatacggttctgttatacccca

SEQ ID NO: 4672 - DNA, 25 bp, Homo sapiens
ggaatgacccttttgtgtctatgat

SEQ ID NO: 4673 - DNA, 25 bp, Homo sapiens
gaatgacccttttgtgtctatgatg

SEQ ID NO: 4674 - DNA, 25 bp, Homo sapiens
gacccttttgtgtctatgatgttgc

SEQ ID NO: 4675 - DNA, 25 bp, Homo sapiens
tgtgtctatgatgttgctgttcaca

SEQ ID NO: 4676 - DNA, 25 bp, Homo sapiens
ttgataggcctagtacaatcttggg

SEQ ID NO: 4677 - DNA, 25 bp, Homo sapiens
ataggcctagtacaatcttgggaac

SEQ ID NO: 4678 - DNA, 25 bp, Homo sapiens
ctagtacaatcttgggaacagggtt

SEQ ID NO: 4679 - DNA, 25 bp, Homo sapiens
gcctatcttaggtagtcatgctgtg

SEQ ID NO: 4680 - DNA, 25 bp, Homo sapiens
atcttaggtagtcatgctgtgcatt

SEQ ID NO: 4681 - DNA, 25 bp, Homo sapiens
ttgtgtatgtacttagctgtactat

SEQ ID NO: 4682 - DNA, 25 bp, Homo sapiens
atgtacttagctgtactataagtag

SEQ ID NO: 4683 - DNA, 25 bp, Homo sapiens
acttagctgtactataagtagttgg

SEQ ID NO: 4684 - DNA, 25 bp, Homo sapiens
ataagtagttggtttgtatgagatg

SEQ ID NO: 4685 - DNA, 25 bp, Homo sapiens
tagttggtttgtatgagatggttaa

SEQ ID NO: 4686 - DNA, 25 bp, Homo sapiens
agttggtttgtatgagatggttaaa

SEQ ID NO: 4687 - DNA, 25 bp, Homo sapiens
ttttccttttttgtctatgaagttg

SEQ ID NO: 4688 - DNA, 25 bp, Homo sapiens
cacttcccgtctcagaatctaaacg

SEQ ID NO: 4689 - DNA, 25 bp, Homo sapiens
acttcccgtctcagaatctaaacgt

SEQ ID NO: 4690 - DNA, 25 bp, Homo sapiens
caccttcgagtagagaggcccgccc

SEQ ID NO: 4691 - DNA, 25 bp, Homo sapiens
caacccaaaccatgagaatttgcaa

SEQ ID NO: 4692 - DNA, 25 bp, Homo sapiens
tgagaatttgcaacaggggaggaaa

SEQ ID NO: 4693 - DNA, 25 bp, Homo sapiens
ccaaaccagccttcggagcgttctc

SEQ ID NO: 4694 - DNA, 25 bp, Homo sapiens
caaaccagccttcggagcgttctct

SEQ ID NO: 4695 - DNA, 25 bp, Homo sapiens
ccagccttcggagcgttctctgtcc

SEQ ID NO: 4696 - DNA, 25 bp, Homo sapiens
tcttattccgagcattccagtaact

SEQ ID NO: 4697 - DNA, 25 bp, Homo sapiens
acttcttctgcatgatgtgtggtag

SEQ ID NO: 4698 - DNA, 25 bp, Homo sapiens
tctgcatgatgtgtggtagactccc

SEQ ID NO: 4699 - DNA, 25 bp, Homo sapiens
acagcacgtaacctagtgagtgact

SEQ ID NO: 4700 - DNA, 25 bp, Homo sapiens
cgtaacctagtgagtgactgtactc

SEQ ID NO: 4701 - DNA, 25 bp, Homo sapiens
agtgactgtactcctttctaggaat

SEQ ID NO: 4702 - DNA, 25 bp, Homo sapiens
tgtactcctttctaggaatgctgat

SEQ ID NO: 4703 - DNA, 25 bp, Homo sapiens
cctttctaggaatgctgattcagag

SEQ ID NO: 4704 - DNA, 25 bp, Homo sapiens
tgctgattcagagtgcacctctttg

SEQ ID NO: 4705 - DNA, 25 bp, Homo sapiens
aggatccccttgtccctggagtagg

SEQ ID NO: 4706 - DNA, 25 bp, Homo sapiens
ttgtccctggagtagggactaacta

SEQ ID NO: 4707 - DNA, 25 bp, Homo sapiens
tgatgtaccaataagtggagattcc

SEQ ID NO: 4708 - DNA, 25 bp, Homo sapiens
ataagtggagattcctccttatgat

SEQ ID NO: 4709 - DNA, 25 bp, Homo sapiens
aagtggagattcctccttatgatgt

SEQ ID NO: 4710 - DNA, 25 bp, Homo sapiens
tggagattcctccttatgatgtatg

SEQ ID NO: 4711 - DNA, 25 bp, Homo sapiens
ggagattcctccttatgatgtatgc

SEQ ID NO: 4712 - DNA, 25 bp, Homo sapiens
gattcctccttatgatgtatgctag

SEQ ID NO: 4713 - DNA, 25 bp, Homo sapiens
ttgacatctattccacccgagagcc

SEQ ID NO: 4714 - DNA, 25 bp, Homo sapiens
cagcgcatctccttctgcctagata

SEQ ID NO: 4715 - DNA, 25 bp, Homo sapiens
cgagaacagcaggacttggagtttg

SEQ ID NO: 4716 - DNA, 25 bp, Homo sapiens
caggacttggagtttgccaaggaga

SEQ ID NO: 4717 - DNA, 25 bp, Homo sapiens
gatgatgacagcttcccttgagctg

SEQ ID NO: 4718 - DNA, 25 bp, Homo sapiens
atgatgacagcttcccttgagctgg

SEQ ID NO: 4719 - DNA, 25 bp, Homo sapiens
acacacagctcatatgctgcattcg

SEQ ID NO: 4720 - DNA, 25 bp, Homo sapiens
cacacagctcatatgctgcattcgt

SEQ ID NO: 4721 - DNA, 25 bp, Homo sapiens
acagctcatatgctgcattcgtgca

SEQ ID NO: 4722 - DNA, 25 bp, Homo sapiens
gctcatatgctgcattcgtgcaggg

SEQ ID NO: 4723 - DNA, 25 bp, Homo sapiens
ctcatatgctgcattcgtgcagggg

SEQ ID NO: 4724 - DNA, 25 bp, Homo sapiens
aggatagttctgtgtactcctttag

SEQ ID NO: 4725 - DNA, 25 bp, Homo sapiens
gatagttctgtgtactcctttaggg

SEQ ID NO: 4726 - DNA, 25 bp, Homo sapiens
agttctgtgtactcctttagggagt

SEQ ID NO: 4727 - DNA, 25 bp, Homo sapiens
actagaactgggatgtcttggcttg

SEQ ID NO: 4728 - DNA, 25 bp, Homo sapiens
ctagaactgggatgtcttggcttgt

SEQ ID NO: 4729 - DNA, 25 bp, Homo sapiens
ttgttgttcttagacaagtgcctcc

SEQ ID NO: 4730 - DNA, 25 bp, Homo sapiens
tatagctacatactcctggcattgc

SEQ ID NO: 4731 - DNA, 25 bp, Homo sapiens
atagctacatactcctggcattgca

SEQ ID NO: 4732 - DNA, 25 bp, Homo sapiens
tagctacatactcctggcattgcac

SEQ ID NO: 4733 - DNA, 25 bp, Homo sapiens
gctacatactcctggcattgcactt

SEQ ID NO: 4734 - DNA, 25 bp, Homo sapiens
cctggcattgcactttttaaccttg

SEQ ID NO: 4735 - DNA, 25 bp, Homo sapiens
ctggcattgcactttttaaccttgc

SEQ ID NO: 4736 - DNA, 25 bp, Homo sapiens
tggcattgcactttttaaccttgct

SEQ ID NO: 4737 - DNA, 25 bp, Homo sapiens
gcattgcactttttaaccttgctga

SEQ ID NO: 4738 - DNA, 25 bp, Homo sapiens
ccttgctgacatccaaatagaagat

SEQ ID NO: 4739 - DNA, 25 bp, Homo sapiens
cttgctgacatccaaatagaagata

SEQ ID NO: 4740 - DNA, 25 bp, Homo sapiens
ttgctgacatccaaatagaagatag

SEQ ID NO: 4741 - DNA, 25 bp, Homo sapiens
tgctgacatccaaatagaagatagg

SEQ ID NO: 4742 - DNA, 25 bp, Homo sapiens
gctgacatccaaatagaagatagga

SEQ ID NO: 4743 - DNA, 25 bp, Homo sapiens
gataggactatctaagccctaggtt

SEQ ID NO: 4744 - DNA, 25 bp, Homo sapiens
ataggactatctaagccctaggttt

SEQ ID NO: 4745 - DNA, 25 bp, Homo sapiens
cttcattggataacttgaaggcttt

SEQ ID NO: 4746 - DNA, 25 bp, Homo sapiens
tgacagttccctcatctttgagatg

SEQ ID NO: 4747 - DNA, 25 bp, Homo sapiens
cagttccctcatctttgagatgcac

SEQ ID NO: 4748 - DNA, 25 bp, Homo sapiens
catctttgagatgcactgatcactg

SEQ ID NO: 4749 - DNA, 25 bp, Homo sapiens
ctttgagatgcactgatcactgtgc

SEQ ID NO: 4750 - DNA, 25 bp, Homo sapiens
gatgcactgatcactgtgcttgaaa

SEQ ID NO: 4751 - DNA, 25 bp, Homo sapiens
gcactgatcactgtgcttgaaaaag

SEQ ID NO: 4752 - DNA, 25 bp, Homo sapiens
ctgatcactgtgcttgaaaaagaca

SEQ ID NO: 4753 - DNA, 25 bp, Homo sapiens
atcactgtgcttgaaaaagacaata

SEQ ID NO: 4754 - DNA, 25 bp, Homo sapiens
aggatgactaatcgttctgcttctg

SEQ ID NO: 4755 - DNA, 25 bp, Homo sapiens
actaatcgttctgcttctgagtaca

SEQ ID NO: 4756 - DNA, 25 bp, Homo sapiens
cgttctgcttctgagtacattttcc

SEQ ID NO: 4757 - DNA, 25 bp, Homo sapiens
tctgtcaaggtacacagcggtgcct

SEQ ID NO: 4758 - DNA, 25 bp, Homo sapiens
gtcaaggtacacagcggtgcctttg

SEQ ID NO: 4759 - DNA, 25 bp, Homo sapiens
cacagcggtgcctttgtaaatgttc

SEQ ID NO: 4760 - DNA, 25 bp, Homo sapiens
agcggtgcctttgtaaatgttcatt

SEQ ID NO: 4761 - DNA, 25 bp, Homo sapiens
gtgctgcctttgcatgggcctggcc

SEQ ID NO: 4762 - DNA, 25 bp, Homo sapiens
tctttttctcaggagctacaaagat

SEQ ID NO: 4763 - DNA, 25 bp, Homo sapiens
ctccacacacgacagagatgcaggg

SEQ ID NO: 4764 - DNA, 25 bp, Homo sapiens
ccacacacgacagagatgcaggggc

SEQ ID NO: 4765 - DNA, 25 bp, Homo sapiens
acacacgacagagatgcaggggcca

SEQ ID NO: 4766 - DNA, 25 bp, Homo sapiens
ttgtgcgggtgttgaccgatgtatc

SEQ ID NO: 4767 - DNA, 25 bp, Homo sapiens
tgtgcgggtgttgaccgatgtatct

SEQ ID NO: 4768 - DNA, 25 bp, Homo sapiens
gtgcgggtgttgaccgatgtatctt

SEQ ID NO: 4769 - DNA, 25 bp, Homo sapiens
ggtgttgaccgatgtatcttttcct

SEQ ID NO: 4770 - DNA, 25 bp, Homo sapiens
gtgttgaccgatgtatcttttcctt

SEQ ID NO: 4771 - DNA, 25 bp, Homo sapiens
gttgaccgatgtatcttttccttaa

SEQ ID NO: 4772 - DNA, 25 bp, Homo sapiens
tgaccgatgtatcttttccttaaag

SEQ ID NO: 4773 - DNA, 25 bp, Homo sapiens
gaccgatgtatcttttccttaaagt

SEQ ID NO: 4774 - DNA, 25 bp, Homo sapiens
tttgtcaataaagcattcctttggg

SEQ ID NO: 4775 - DNA, 25 bp, Homo sapiens
ttgtcaataaagcattcctttgggg

SEQ ID NO: 4776 - DNA, 25 bp, Homo sapiens
gtcaataaagcattcctttggggga

SEQ ID NO: 4777 - DNA, 25 bp, Homo sapiens
tgactttagctgatactcttatgta

SEQ ID NO: 4778 - DNA, 25 bp, Homo sapiens
tagctgatactcttatgtacgagat

SEQ ID NO: 4779 - DNA, 25 bp, Homo sapiens
atactcttatgtacgagatctgtct

SEQ ID NO: 4780 - DNA, 25 bp, Homo sapiens
acgagatctgtctctgctgtttaac

SEQ ID NO: 4781 - DNA, 25 bp, Homo sapiens
tctgctgtttaacttcattggatta

SEQ ID NO: 4782 - DNA, 25 bp, Homo sapiens
aatcagctggtttcaactctactgc

SEQ ID NO: 4783 - DNA, 25 bp, Homo sapiens
ctggtttcaactctactgcgaaaca

SEQ ID NO: 4784 - DNA, 25 bp, Homo sapiens
ggtttcaactctactgcgaaacaaa

SEQ ID NO: 4785 - DNA, 25 bp, Homo sapiens
attctttagctttcttaatcggtgc

SEQ ID NO: 4786 - DNA, 25 bp, Homo sapiens
atggaggccagtgtaacgttacatg

SEQ ID NO: 4787 - DNA, 25 bp, Homo sapiens
gtaacgttacatgactcgttgagaa

SEQ ID NO: 4788 - DNA, 25 bp, Homo sapiens
cgttacatgactcgttgagaaagtt

SEQ ID NO: 4789 - DNA, 25 bp, Homo sapiens
ctaccacctttgttgcttgaagaaa

SEQ ID NO: 4790 - DNA, 25 bp, Homo sapiens
taccacctttgttgcttgaagaaaa

SEQ ID NO: 4791 - DNA, 25 bp, Homo sapiens
tgtcttttcaaaatgagaggctttc

SEQ ID NO: 4792 - DNA, 25 bp, Homo sapiens
tcttttcaaaatgagaggctttcat

SEQ ID NO: 4793 - DNA, 25 bp, Homo sapiens
atattatactttagggcaaccctag

SEQ ID NO: 4794 - DNA, 25 bp, Homo sapiens
tactttagggcaaccctagttggca

SEQ ID NO: 4795 - DNA, 25 bp, Homo sapiens
ttagggcaaccctagttggcagctt

SEQ ID NO: 4796 - DNA, 25 bp, Homo sapiens
tagggcaaccctagttggcagcttt

SEQ ID NO: 4797 - DNA, 25 bp, Homo sapiens
agggcaaccctagttggcagctttg

SEQ ID NO: 4798 - DNA, 25 bp, Homo sapiens
ggcaaccctagttggcagctttgag

SEQ ID NO: 4799 - DNA, 25 bp, Homo sapiens
accctagttggcagctttgagagaa

SEQ ID NO: 4800 - DNA, 25 bp, Homo sapiens
ccctagttggcagctttgagagaag

SEQ ID NO: 4801 - DNA, 25 bp, Homo sapiens
cctagttggcagctttgagagaagt

SEQ ID NO: 4802 - DNA, 25 bp, Homo sapiens
ttggcagctttgagagaagttcttc

SEQ ID NO: 4803 - DNA, 25 bp, Homo sapiens
ttccattaaacatggaaggaataac

SEQ ID NO: 4804 - DNA, 25 bp, Homo sapiens
aatagggaacttgacagcagacaga

SEQ ID NO: 4805 - DNA, 25 bp, Homo sapiens
atagggaacttgacagcagacagag

SEQ ID NO: 4806 - DNA, 25 bp, Homo sapiens
ggaacttgacagcagacagagggaa

SEQ ID NO: 4807 - DNA, 25 bp, Homo sapiens
gaacttgacagcagacagagggaag

SEQ ID NO: 4808 - DNA, 25 bp, Homo sapiens
acttgacagcagacagagggaagag

SEQ ID NO: 4809 - DNA, 25 bp, Homo sapiens
atttttcacatataagtgggctaac

SEQ ID NO: 4810 - DNA, 25 bp, Homo sapiens
tttcacatataagtgggctaaccaa

SEQ ID NO: 4811 - DNA, 25 bp, Homo sapiens
aactagcccttaattatggtgacag

SEQ ID NO: 4812 - DNA, 25 bp, Homo sapiens
cccttaattatggtgacagttcctt

SEQ ID NO: 4813 - DNA, 25 bp, Homo sapiens
gagattactctagcaactattacag

SEQ ID NO: 4814 - DNA, 25 bp, Homo sapiens
aattatttggtgtggccatcttacc

SEQ ID NO: 4815 - DNA, 25 bp, Homo sapiens
tttggtgtggccatcttacctgctt

SEQ ID NO: 4816 - DNA, 25 bp, Homo sapiens
ttggtgtggccatcttacctgctta

SEQ ID NO: 4817 - DNA, 25 bp, Homo sapiens
ggccatcttacctgcttatgtctcc

SEQ ID NO: 4818 - DNA, 25 bp, Homo sapiens
catcttactgttgatatatgtatgc

SEQ ID NO: 4819 - DNA, 25 bp, Homo sapiens
tcttactgttgatatatgtatgctc

SEQ ID NO: 4820 - DNA, 25 bp, Homo sapiens
tatatgtatgctctggtacacagat

SEQ ID NO: 4821 - DNA, 25 bp, Homo sapiens
gctctggtacacagatgtcattttg

SEQ ID NO: 4822 - DNA, 25 bp, Homo sapiens
gtacacagatgtcattttgttgtca

SEQ ID NO: 4823 - DNA, 25 bp, Homo sapiens
cagatgtcattttgttgtcacagca

SEQ ID NO: 4824 - DNA, 25 bp, Homo sapiens
tcattttgttgtcacagcactacag

SEQ ID NO: 4825 - DNA, 25 bp, Homo sapiens
tgccaaaaccaagattttgaaggaa

SEQ ID NO: 4826 - DNA, 25 bp, Homo sapiens
tgtggcctgcccagcctcaatgtca

SEQ ID NO: 4827 - DNA, 25 bp, Homo sapiens
cagcagcatcccagccttgagatgc

SEQ ID NO: 4828 - DNA, 25 bp, Homo sapiens
cccagccttgagatgcttcactttc

SEQ ID NO: 4829 - DNA, 25 bp, Homo sapiens
gccttgagatgcttcactttccttc

SEQ ID NO: 4830 - DNA, 25 bp, Homo sapiens
tctgtaaccagactttgaaaaattg

SEQ ID NO: 4831 - DNA, 25 bp, Homo sapiens
ctgtaaccagactttgaaaaattgt

SEQ ID NO: 4832 - DNA, 25 bp, Homo sapiens
taaccagactttgaaaaattgttcg

SEQ ID NO: 4833 - DNA, 25 bp, Homo sapiens
aaattgttcgtttcatcaggctctg

SEQ ID NO: 4834 - DNA, 25 bp, Homo sapiens
gttcgtttcatcaggctctgttcct

SEQ ID NO: 4835 - DNA, 25 bp, Homo sapiens
tcatcaggctctgttcctcaatggc

SEQ ID NO: 4836 - DNA, 25 bp, Homo sapiens
tcaggctctgttcctcaatggcctt

SEQ ID NO: 4837 - DNA, 25 bp, Homo sapiens
tcctcaatggccttttgctacgtgc

SEQ ID NO: 4838 - DNA, 25 bp, Homo sapiens
ccttttgctacgtgcctcccgagaa

SEQ ID NO: 4839 - DNA, 25 bp, Homo sapiens
ttgctacgtgcctcccgagaaattt

SEQ ID NO: 4840 - DNA, 25 bp, Homo sapiens
tgcctcccgagaaatttgtcttttt

SEQ ID NO: 4841 - DNA, 25 bp, Homo sapiens
atgcaggaggcttggaagtataacc

SEQ ID NO: 4842 - DNA, 25 bp, Homo sapiens
atgcaaactcctaagagatactctg

SEQ ID NO: 4843 - DNA, 25 bp, Homo sapiens
aagagatactctgcagagcttcagc

SEQ ID NO: 4844 - DNA, 25 bp, Homo sapiens
gcagagcttcagctggaatggtcgt

SEQ ID NO: 4845 - DNA, 25 bp, Homo sapiens
cttcagctggaatggtcgtggattc

SEQ ID NO: 4846 - DNA, 25 bp, Homo sapiens
agctggaatggtcgtggattcacag

SEQ ID NO: 4847 - DNA, 25 bp, Homo sapiens
tagaagagcaaaccacgtcccacga

SEQ ID NO: 4848 - DNA, 25 bp, Homo sapiens
aagagcaaaccacgtcccacgaatc

SEQ ID NO: 4849 - DNA, 25 bp, Homo sapiens
cgaatcccaataatgacagcttcag

SEQ ID NO: 4850 - DNA, 25 bp, Homo sapiens
ccaataatgacagcttcagactttg

SEQ ID NO: 4851 - DNA, 25 bp, Homo sapiens
ataatgacagcttcagactttgttt

SEQ ID NO: 4852 - DNA, 25 bp, Homo sapiens
cacttgccagcagtagaaaaaggac

SEQ ID NO: 4853 - DNA, 25 bp, Homo sapiens
cttgccagcagtagaaaaaggaccg

SEQ ID NO: 4854 - DNA, 25 bp, Homo sapiens
ttgccagcagtagaaaaaggaccga

SEQ ID NO: 4855 - DNA, 25 bp, Homo sapiens
aggaccgactataccgacctttctg

SEQ ID NO: 4856 - DNA, 25 bp, Homo sapiens
ccgacctttctgattagtaaacagt

SEQ ID NO: 4857 - DNA, 25 bp, Homo sapiens
aaaggcacctaagctattgctaatt

SEQ ID NO: 4858 - DNA, 25 bp, Homo sapiens
acctaagctattgctaattgaattg

SEQ ID NO: 4859 - DNA, 25 bp, Homo sapiens
ctatgtatctagtattgaggcttgc

SEQ ID NO: 4860 - DNA, 25 bp, Homo sapiens
atgtatctagtattgaggcttgctc

SEQ ID NO: 4861 - DNA, 25 bp, Homo sapiens
ttgaggcttgctctttcatgtggct

SEQ ID NO: 4862 - DNA, 25 bp, Homo sapiens
cttgctctttcatgtggctttatcc

SEQ ID NO: 4863 - DNA, 25 bp, Homo sapiens
tgctctttcatgtggctttatcctc

SEQ ID NO: 4864 - DNA, 25 bp, Homo sapiens
tgtggctttatcctctctttaatag

SEQ ID NO: 4865 - DNA, 25 bp, Homo sapiens
gtggctttatcctctctttaatagc

SEQ ID NO: 4866 - DNA, 25 bp, Homo sapiens
cttcaggatcagcttgcagagtctt

SEQ ID NO: 4867 - DNA, 25 bp, Homo sapiens
gatcagcttgcagagtcttgctttt

SEQ ID NO: 4868 - DNA, 25 bp, Homo sapiens
atcagcttgcagagtcttgctttta

SEQ ID NO: 4869 - DNA, 25 bp, Homo sapiens
cttgcagagtcttgcttttaggtta

SEQ ID NO: 4870 - DNA, 25 bp, Homo sapiens
tcttgcttttaggttagatacaaac

SEQ ID NO: 4871 - DNA, 25 bp, Homo sapiens
aacagctggctttggaatggagaac

SEQ ID NO: 4872 - DNA, 25 bp, Homo sapiens
agctggctttggaatggagaacact

SEQ ID NO: 4873 - DNA, 25 bp, Homo sapiens
ggaatcgtggcaatttctcttagaa

SEQ ID NO: 4874 - DNA, 25 bp, Homo sapiens
cgtggcaatttctcttagaaagtag

SEQ ID NO: 4875 - DNA, 25 bp, Homo sapiens
gtgactacctgtacagttgcactat

SEQ ID NO: 4876 - DNA, 25 bp, Homo sapiens
gtacagttgcactatgttcttcata

SEQ ID NO: 4877 - DNA, 25 bp, Homo sapiens
atacaaaatttacattcaagctggg

SEQ ID NO: 4878 - DNA, 25 bp, Homo sapiens
tacaaaatttacattcaagctgggt

SEQ ID NO: 4879 - DNA, 25 bp, Homo sapiens
aaatttacattcaagctgggtcttt

SEQ ID NO: 4880 - DNA, 25 bp, Homo sapiens
ttacattcaagctgggtctttacta

SEQ ID NO: 4881 - DNA, 25 bp, Homo sapiens
attcaagctgggtctttactactga

SEQ ID NO: 4882 - DNA, 25 bp, Homo sapiens
gctgggtctttactactgaaaataa

SEQ ID NO: 4883 - DNA, 25 bp, Homo sapiens
gaaatatgccaggattcttttgttc

SEQ ID NO: 4884 - DNA, 25 bp, Homo sapiens
aatatgccaggattcttttgttcaa

SEQ ID NO: 4885 - DNA, 25 bp, Homo sapiens
cattacacagctttgcttctttggt

SEQ ID NO: 4886 - DNA, 25 bp, Homo sapiens
acagctttgcttctttggttacaaa

SEQ ID NO: 4887 - DNA, 25 bp, Homo sapiens
gctttgcttctttggttacaaagta

SEQ ID NO: 4888 - DNA, 25 bp, Homo sapiens
ctttgcttctttggttacaaagtag

SEQ ID NO: 4889 - DNA, 25 bp, Homo sapiens
agggtccagcctcaagatcctctcc

SEQ ID NO: 4890 - DNA, 25 bp, Homo sapiens
cctcaagatcctctccaaaggaaag

SEQ ID NO: 4891 - DNA, 25 bp, Homo sapiens
cctctccaaaggaaagcgaggtgga

SEQ ID NO: 4892 - DNA, 25 bp, Homo sapiens
cattcatctgtttccactgagtctg

SEQ ID NO: 4893 - DNA, 25 bp, Homo sapiens
gtttccactgagtctgagtcttcaa

SEQ ID NO: 4894 - DNA, 25 bp, Homo sapiens
gagtctgagtcttcaagttttcact

SEQ ID NO: 4895 - DNA, 25 bp, Homo sapiens
ttcaagttttcactccagctaacac

SEQ ID NO: 4896 - DNA, 25 bp, Homo sapiens
gtgtgtctaggcaggacctgtggcc

SEQ ID NO: 4897 - DNA, 25 bp, Homo sapiens
atcacgtaaagctagaaatgatccc

SEQ ID NO: 4898 - DNA, 25 bp, Homo sapiens
tgatccccagctgtttatgcataga

SEQ ID NO: 4899 - DNA, 25 bp, Homo sapiens
tgcatagataatctctccattcccg

SEQ ID NO: 4900 - DNA, 25 bp, Homo sapiens
agacgtgattttgctgtagaagatg

SEQ ID NO: 4901 - DNA, 25 bp, Homo sapiens
agatggcacttataaccaaagccca

SEQ ID NO: 4902 - DNA, 25 bp, Homo sapiens
atgctggtttttcagttttcaggag

SEQ ID NO: 4903 - DNA, 25 bp, Homo sapiens
tgatttcagcacctacagtgtacag

SEQ ID NO: 4904 - DNA, 25 bp, Homo sapiens
cacctacagtgtacagtcttgtatt

What is claimed is:

1. A method for confirming a diagnosis of renal cell carcinoma (RCC) in a human, the method comprising the steps of:
   a) providing at least one peripheral blood sample of a human;
   b) generating an expression profile comprising expression levels of two RCC disease genes in said at least one peripheral blood sample of the human;
   c) comparing the expression profile generated in step b) to at least one reference expression profile comprising expression levels of said two RCC disease genes wherein the reference expression profile is obtained from peripheral blood samples from patients having RCC or peripheral blood samples from disease-free humans, wherein said comparison is used to indicate the presence or absence of RCC in the human; and
   wherein (i) the human has a prior diagnosis of RCC and (ii) said two RCC disease genes are eukaryotic elongation factor 1 alpha 2 (EEF1A2, SEQ ID NO:285) and toll-like receptor 2 (TLR2, SEQ ID NO:1).

2. The method according to claim 1, wherein said peripheral blood sample comprises enriched peripheral blood mononuclear cells (PBMCs).

3. The method according to claim 1, wherein said peripheral blood sample is a whole blood sample.

4. The method according to claim 1, wherein the expression profile generated in step (b) is generated using quantitative RT-PCR or an immunoassay.

5. The method according to claim 1, wherein said at least one reference expression profile comprises a reference expression profile comprising expression levels of said two RCC disease genes in peripheral blood samples of disease-free humans.

6. The method according to claim 5, wherein said at least one reference expression profile further comprises a reference expression profile comprising expression levels of said two RCC disease genes in peripheral blood samples of patients having RCC.

7. The method according to claim 6, wherein the expression profile generated in step (b) is compared to said at least one reference expression profile using a weighted voting algorithm.

* * * * *